United States Patent 9,976,180 (METHODS FOR DETECTING A GENETIC VARIATION IN SUBJECTS WITH PARKINSONISM) - sequence listing, part 40

SEQ ID NO: 499 - DNA, 336398 bp, Homo sapiens
tcgcatggattccctttattgaactgtactagttactgcagtcagattaagtcacatttaaaagcagaccatccagttgcactgaaaccgattatattcattacatagttttaatcactgtccggtgaactggcaaatccaatcaaagcattagtctttaattaaaaaattaaaaggaaatattcagacaatagccaagcaatcacatcacgatgcacaattacctagaattgcaattaaaaagtagttaaccgaagggggtggggggtgggggggaagaaaaacaagaaagaaaaaaaagaagcaaagaaaaaaaatcacactaattcttttttaaaaactatcaatataatacatgaaggaacaaaggacaatagccttaaaaagcaggtttctctaactctagaaatgtagtctgcggcggaaagtctaaaagcacactagctgtagcaggacaataaaaaatactgagcatggaatacttttaatctctgccattaatattcatttccagctgcttataatagcagcgcctcatggccaaatcattagagttttacatctgggttgcaaatgacactttgattggatgtaatgttcaaatggccctccccacggcgtctccggcaagccttctgcggagaggtgtcctgttgagcgatccctcactgtgcgtgctggctcatcgtgtggttctgcaaaggcgaagaaaggagacacacatgaaggagaagaatggagagcatgctcgtccctcccactcagtgcatttacgccgggagccgcagaaaagcgtctcgattataacaaaacaaaatgcaacaaggaaaaagtgctccagggacgcagctgccaagacgccacgttgatttggggcttggggataggttcctgttactgccaacttggactccctatatgttgttttttggctttttttttttttttttttttaaagaccattcaggtcttaccggggggactggctaggtggagggaaaggggaaatgccggggaggaggcaggaattaaaaacatccctgttcacctctccatctcccttttcctctaatgaagaggaggaaactctgatcgcctgcaggctgccctcgcatccccctctcagtcttccccgtggctgctccgagcctagcagagggagacagcagatgtgctgtgcagctctccggccaagaaacacccgagcgggcacaggcgtgctgaggcagtgggcggccgtggtgcctgcggcccaggcaggggacaggtcacccggcaggaagacgcgggaggagcctctgctgctgggctccgggagcctgcctgcttggtcacatggcaatggcccaaccagagacagggactcagtgcagtttggccgaatgcacctaggaatccagggcccaggtgggaccctgtggccaaatgtttccctctcattacagtcaatggcatttcctccccctgccagccagagggggccagcagggttgatctgtttcacaggagccagcggcctgggactgggggtgggatttggcatctgaaagccgtctttttgtttcttttcagtggttcgtgttccaaattcagacccatttcatcaaagcctcaggtggtgctccacctcatgacacctggagaaaggaggcaacatccaccaggtgtagggtggccctgtttggggccgcacaggaccctagatccccgggagaggctccttctgggcgccccccagggcccggcgactcctgcagctgtgccgctgaccgccaggggtcagcagaggcaccgcgtctctcctgggctcgggtccgcggcgagggcgaccaggtgatgccagtagcctcgcccggaggccgaggccggggccggggccggggccggggccgagacgggccactcctgctccctggagcagggccccgcgcagtcccttcccgtgacgggcactgcgaaggctgcggcccccgtggtaatgtcaccgacccttcctgcgagctcccggccgggaagaggcagcccgcgcctgcctcccagcagatgcccacagcgccaagcgacagcctcgtgctcatgcgggcggagcaggcgcacggccggggcttggtgggcatgcgtgctctgtgccgtggcaggcaccgctctttcaatcctcacaacagccttgcgaggtgggacttcttaagatgaagacaccgaggcctaggaaggcaaaaattacaggcccaaggtcacccaggttggaagcaccgggcactgaaccagatggctggaatccactagagcaaggggattttcaggggagccaggcttcccagggcctgcaccccatgggcaccgcagtctgcaaatcacccgcattctgcaccagacacagtgccacctctgccggccgggcctgacacctcggtcgggggcgtcagggacccagaggcaccaggcaggttgtctgaggccacagatgggatgcaggcggtttccatgggaacccgcaccctccagccgtggcacctctccctgtacttgtgcagggacagccagctagtcctgtggggagccgaatccacactctacacagccatcctcctgctaccttcaagcctctgctgactcagttcccgcctcccttctcctccctcccaaccaagctgctctttgagtcctctaggcacatggatcacttcccatccctgcagacctctccaggcacctgcagcccacctcccacacagccacgcacctctcatgagctagactgacctcctttgctgagctgcacacagggtggcggcacctcctttctcaggacccagggctgggcatgcactgtcctgaccatacgcctgggcctccaatccccagcaggcacagctgcccaggagcaacttggaggtctgcactttcacaccctgccaaccgccagtcaaaaacccctgctatcttggtgtgggtgggtcattctttattagggggaggacagggaggaggaagagaggggacatgaggaagggagacatggacagctctttcttgtcctcaaattatggttcctagggcctggcacaaagtagacactcaggcagtatttgtgaatgagtcaatggaaagaaaacgaatgaatgtatggataggatgtggatatgtggaaaggggagagggcattccaagaggaaagaatagcagagacggaggtgtggagcctagaatccaagtggcgatgcaggcacaggtcccagcacagaagtcacaggaaggctggtgggcacatggcctacggacagtggaggccttgagtaccaacaaacatggactttgttccacaggccacagaaaaccagacatgatattcgatctccacaaaatccccaaggaccacccactaccaacatgggcacagggggtgtctgggatctctggagaatgaagcagcctgttgccaggatgccaagaacaggctcagtgtgacacacatggcccacactggctcaccagggcactgctggtgcagacatgatgaaggctggaacccacacctgggaccactggtgaggaaaactccagaatgcctatgccattccccaggaaaagccacagtgtgcctgcccacttaaatagcagtagcagggggctctgaggttacactcaagaaagaacttcctcctagagggttctgagacagaaggataaaacttccttccctgaagttttgtgacaggaacaaaagcccaggatgtcacagcagatggaaatgtcaaaacttgatgccccaaggggaccaggcaccagaattcactcagcactacattattaagcacctgctggatgctctgctctgcactggcacagtgagggggaggggaagacaccagctgggcctacccctcgaggggcctgatttagaggggctagacacagacacccaaacatttgtgggattaatggtgcagctggcagctcagctagggaaactggtcaaggtcacccgatcagtttgtgtgatggtggtggggagcccagaggtgcccaggtgctcagccaaggagggcattggctcctccataggccaagggcagtatctcaacaggcagaggaggtggtgggacccctgtccccaagacttaccagtcgcccaacaccaggacacagagcagctctggacagctactgcaatcagcacagttcaataaccgtgaaagaacccgtggtccgtcccccacagctagaagctgtggtttgaggaacgtggggaggttcagcaaaccttcttaaagagttctttccatccagcatagttctcacaagggcattcagccttaatgtctctttctctgtttatgcctgtgctatatttagcccctttagagaaggaagaaaatcgttttttaaagatgctacccaccccacagatgaacacttcccaccaccataaaggctgggggtggagacaggggcccagggaaggactggaaaatgcctagagggaggcctggcatccactcggcctcgctgcctgccagggagacacaggtgtgggccagagaagcaggtgaggaaaataaaacgggagagcaggagggggtgggcagcaatggtttgcagcctcaatccatccactcagcagagctcgtgtgctctcctggatggaggtttctggtacagcctgttttgggggcctctgcctggcacacggggccagggacacaagacagtgatagccaaggggatggcatgggcccgggcacagaaacctgtgtgctgcctatgctgggggcaggcctaccctgggtcctggtgagacccacaaaaagagccctctctgtgcaaatcgtcagcagagcactcaggaactggttccctgacacaccctcagcctctggaaggaaagaagcccagcattcatttcatggttgctcattcattcattcgtctttgagccaatgagccactatgcttgttgctgggaattcagcagcaaaatgatcctgatcctgaacccaatccagggtaatgttttgtgcatggaaggagcgggccagagtacagagcctggtggctacactgtccttcccaaagcaccgccacacactagagggaatgggctccttggaggttcagctggggtctgatgctggttttgcgcgccccaggagggggccctggctcagcccacctccatgcccaacacagtcacaaacaggaacactgtgtgcctctccctagtgtgaagcccaggattgcttctcaagatcttggctccattctctgttgcttaggcgtgggaccctgcctggtctccctttgatacctatccatcaccatgtcaagtgggagagacgtgaggggcttaagcatgccagcagcataaagcaaaagagcttctccacacaccctgctagctgcctctcctggctctcagctactctgaggacagtgtctgtaaagtcctagcaccttgccttgtccttggcaagtgctccattggtgctagccactgccctggtgacctcaaggtgggcaggaagctttcgtgggccgagatgggctacgccttgggtttgaatcttggctctgccacttactggccatgtggccttgggcaagttctgtgacctccgggttttgggggtggttaataacacagccctcttcctaagatgctgatagggtttggatgtttgtcccctccaaatctcatgttgaaatgggatccccagtgttggaggtggggcctagtgggaggtgtttaggtcatgggagaggatccctcacggacagcttggtgtcctctgggcagtaatgacttaccattagatctgcttgttaaaaaatgtctggtgcctccttgcaatctctctctctccccatgtgacggactagctccccttgccttccatcatcattggaagcttcctgaggcctcaccagaaacagatggtggcgccttgcttcctgtacagcctatagaactgtgaaccaaataaaactgttttcttcataaattacccagcctcaagtatttctttatagcaacacaaaacagactaatacagatgccctgaggactcaggagataatgcctgcatacgtcccagtctggctacggcaaatgctccacagatctccatagtggtgtctgtgctggtcttcctgacccagcagggtgctctgtggcatgaggactgtcttctggtcttcctgacctggcagggtgctccacggcagagggactgtttgctccctgccacttctgtgggaccaggcacgattggggcttacagtgagggcctcatagaggtttaatggactgaccagctgtacccctcccccttcccctctgggtgtccaaagggctggcaaggtcttaagaacaatcccgagatggctgaactttggatggtcctgcccttggaacaacaggtgtcattatcccctccccataatcccccctggctagaacccctgtacccacaaatcactgctttctcctccccaccctcaggaacagaatgccatgtctgcaggggaggacagcctcagggagactccacaggggatggaataggtgtgcactcatccacccatccactcacccatccatccatccgcccatctattcatctatccatccatccatccatgcatacatttcttccacagatgttcactgagttcctgtctgtcaggccctgggctgggcactgggcacagacaggttgagaagctccagcgccctcccgtgaggagctcacaatttcatggtgagggtgccgatggccaaactcatagaccctgaagaccattaagaggcaaaaaagaaggcttggctcttctctggagactaggccgtggttctggcccttgagtctttgagtccctatagcatatgaaggcacaagaacactcagcccccacacccagagcatcccaccctgctctcccggccccacctgcagagccacccggcctgcacatcacctcactgtgatttccggttgggaaagaggttgtggccaatcccccttctccccactgcccaccactggccactccctggcaggttccagccacagtggctctcacaaggctggctttacaactcactttctccaggagctagggccaagcccgagaatgcaccttaaccactgagagattccctttccaggggaagaagtagcccttgaggctgaagtggcagccatgttcgtgctcagcaggggtgaagttgggtcccgttatttgttcacttagcaaacaaggcacctggccctgtgcagtagacggaagagagcaagtgaggcacaatcctggccttttaaggactatagagagaggacttccaataggagatgcttaaggaagaagctggccttttagctgccctttaaggacagcccaggtgaggatttgcactgggtgtgtgtgtgagagcttgagagatggttttccaggcagagtgaacccctggacaacagcacgaaggtgggaatggcaccgatcatgatcgctgctaacactgatggtaggctcactgtgtgccagacaccattcttaacctccacccatattagctcatttaagcctcacgactgccctgcgcattaaatactctcatcctccctattttacagatgagaaaactgaggcgcagagaggcccaggtcctgccactggtgatggcagtgctgggtctgcacccatgcagtctgtctgcagagcccactcttcaccaccacactgttctgcctgtgagatgtgaaaagtgcagcatatgttgggggaacaatgaataattcagcttggcagaagcacagggtatgtgccatggagaccagcctggagaggaaggcgggggccttattgatgaggctccttgatgccagacgaggcagcttgcccttaaatctgggccatggggagccatggaaggtatttgagctgtggagttacaggagaggcaagacacagggagaagctcatgcctccagccaaaaaggtgtgtcagcagggccttctcgcccatcatttccctctgctcccatcccctgttccctggaaaaccttcccctttcctcccacactttacttctttccctttgggaagggtatagatacaggcagccctgcctcccctatctgctgtgtatcacctgggcagcccctctctgcttgtgagcacttatttttagaagaatttgacaatcgtccaagggtctaagacgaacagatggcctgtcttaaaggctcatatgttcgctagtttgcacttctgacaaacggtaagcatactcgagagcacaccataaacagcgccgaatgaatactcagaacacaatttagctaatgcatgtcattaaaattaggagtgagtgatggccaaggttccctctaaatgcctgccctgtgatgcagtcaatcccccggggcccaggctatgacgtggacacacctcacttctcccatgacccccacccagcaagccgaggtttgcctcatttacgcagatggcagggcaaggtttgcccgagtgggtgtgacacccaaccctggcctcagagtgaagctggtggcccactggccttggacaaagccctgagatgtcctatggcagagggagcagcagctcttccatgcacgggatgtgcgtgaggttttcccgtccctgcctgccagacagtgaggcagcctgtcgtctgccaccccggagcagcaggagatgagtgttgcaacgctcagccagggaagctgtctctcatgtgagagcctcaattcatccggaactcccggcctagagggagattccaacttccagggagcaaggggattggctttggggtgggggttctgcagcttccttgccgaaccagtagcagaagcagatgcagcgacctgagtcacctggggtaacatttgagaaagagccacatccacacagcctctgacccagactccttttattgatgccaaccggatccaggttttccgtgttcttgagatgctctatggagccgaggcggggaggagggtgccccccactttccgtgaaccccctcttgccaggacacaaaagaccaacgcaggtggcttggtcaacaatcagttccatgagcaggaaactcttccctcgcatgaaaacgtgggagaaaatattgtggggaagaaaaaagcccaataaactcccaagagggcaggttctgtactgctgtactttggaaataaaacccaccaggggatagattattaggagggaaccgaagccttctattaggaacccagcccgtaaacaggctcccattcagagtcacccaacaaaacaaggggactaataatacctgcctggagggacaggggactcaggggagctgcacttcagaatgcaaatgggccccgtcagtctgtttgtgagcagagaattgggtgagcggtgagactttagatagcagccgtgcaagggaaaatgagagttttatggctgttgtcacaagcaaaggaagatggaatgcttccagggctgcttatagacttgctcctcctcagcaacagagtctatgcctgactctgaggcctgagttaatgtgacccccacctactgctgctgtttctccaaagaaggtgggggtaccctgtggctaagccccttggggacagggtacctagcagcagattcaggactgaaaatcgggggtcctagcaacagtgtgccaggtgaccacaagttcacttctgtggcctttggccccctcctgggtagaaatgctgcactgatcttgtcaacctgtggccactgcaaactccattctaaccacagcagcctgcttgaaaccaggcccccgtgggacagctcatctcaaatatgaattagtgcacagtcccctgccctaaaagagcctgaatcagacccctaaaagatggggccccaatctgatgctgctgggccaggaatccagtcaagtgcacctcttgcaaagccttgagaagagcctggggtggaagtgacgaaactccataaaaaatggcactggagctgggtgagtggctcatgcccggaatcccagcactttggaggctgaagtgggaggatcacttgaagccaggagtttgagatcagcctgggtgaaaccccatctctacgaaaaaaaaaaaaaattaggtgggtgtggtggcgtgtgcctgtagtcccagctactcggatggctgaggcgggaggatcacttgagcccagaaatttgaggctgcagtgaactaggatcatgccagtgcactccagccacagggtgagacctcatttaaaaaaaaaaaaggctattgggtggacgggttctcaaaaccaaaaaagggttcacttcaaagtatatctgttgctcttagtgtgggtcaaagaagatcatgcacgtgaagcagtttgggaagacggaagcacctgtcagcaggggtaccaatgctcagaaaatgtttatgtcatgaaaaagagcgggtgaattccaggagatctgtctgcagtggggaggattcctctgaccacatggaactgcatgtctggatggaggcctcaagattagagtgtgggtgctgtcaggttcacaccatggacaagtgcagcacaggccaggtgcaaagcagtaagacccagtggggtctgtgtcagccccaagaactcaaactttgtcaagaagaggcagcacttgtcagctctaggcaatgactgccacatgcgaatataggcccagtgttgcttccggttttgcaagaaaactggaaatttagatttgtttaaaatatcagctttcttagaggaatgcttatacactgttggtgggaatgcagattagttcagacactgtggaaagcagtttggagatttttcaaagaactaagaattgaactaccattcaacccagcaatcccattactgcagatgcatccaaaggaaaataagcattccaccaaaaagaaacatgaactcatatgtccactgcagcactattgacagtagcgaagacatgaaaccaacccaggcgcccaccaagagtgggttggataatgaaaatgtggtacatatatatatcatggaatattatgcatccataaaaaagaataaaatcatgtcctttgcagcaacatggatgcagctagcagccattatcctaagtgaactaatgcagacacagaaaaccaaataccacatgttctcactcataagtgggagttaaacactgtggtgcgcacagacataaagttgggagcaatagaaactggggaataaaagagctgggagggagggaggggacaagggttgaaaaacaacctatgaggtactatgttcatgacctgggtgatgcattcagtcataccccaaacctcagcagcatgcaatatacccatgtaattaacctgcacatgtattcctggaatctaaaataaaagttgggggaaaacggaagtaaaataaatccataaactttcttgatgtttaaagtactatgcaagcccacgaaaacatatctgcaggttgaatctggccctcgggccaccagcttgagacctctggggttggtgagggcctcgagaagccccagacaccctgaagtgaggtggggagtggtgtcattaggcagcagatggcccaacattagttgaatcctcagccaaggggctgggatgtgggactcggtgtggttaagttctgacaaagagggtaagggtagaagatgaagttctgttaagacagaaccatccatatgtcctgggttctgctgcctcatgggcattcccacccagccagcccaagtgtttctgggtgcgccaggtgctggcaaacctgggagaccaaggagcatgtaaggagaccagaaactcccactttcctagagccacccaggaggctcaacacggctgtctcgggggttgtccgtgggctatctggagagacaagcgccagagtttgccacatgaccgcattcaaaaatctggaccataagtaacccccacaccttccttgcttcaaaggacctgagatccctcccttctaccctccacagtgtcccatggggaataggagaggccaggcatggtagaggggcagccccttggggtgcttacgaaagcagcctcccaaggcagcgttcctattactgtgcacacaccactctatatgcatgcacacacacaaatactctagacacacacacacacacacacacacacacctgcccccgtcatgtgcccaccctccccacacacggataccccccaatcccatgtgcccacacacataggtccccacaatcccatgtgcacgcatacacacacacacacacacacacacacacacatggatgccccacaatcccatgcacactcacacacacacggataccccacaatcccatgcacactcatggacaccccacaaccccatgcaggtacacactcatggataccctcgaatccccccccagaaacacacacacacaccccagtcctgacactaaccatgtagtgctaagcggtcagaggccagttacttttactttggccttctgtctaccctgtgcggctaatctgccccacgttcaccccactgctgagtccctccagcagccccacctgcccaggacgcaagggccccttgaaggcccccttcctggcaaaggaaagctgagaaaacaacgtgaagcacagtccgggttgtctcctcgaggaggcagagctgtagaagggtttctgctttttaaactccctggcgggtcccacccacacccggaacacatccggactctgaccacagcccagatggccctccatggtctggttcttgctggcccacagcctcagccaccaccttctgccaggcccccaaacaccgcagcccggaagcccctccccctcccagcagcactcccgctatccagagtgtcccccacaccccagttttcctggggcttctccacatcggagccatcctcctggagcaggcttcctgtccgctgaccacagactcccatcacaacatcgctctgcaccttgcagaggcttcaactctgcatgtcctgcaacttgcagtgacctggttgttgacgcaccatggccaactgcccctcatgacaccatcagcgcaacaagacagggaccttgtctcagctctccactgtaccccattagctcagagcctgtgcttggtaaaaactcaacgagtatttctgaaatgacagcctgcaagctactgtagcaaagccaggcctccactgatagggtcaagggagaagaagaaaaaatacagttgccccgctccactgtcttccccataacccttgccccggccatgcccagagcaggttatacctttttcttaaagctgggatggatcctttgaggacactaggccaggtggaatgaattattatatgatttctcttgtacgaggtgcctaaaacagccaaatcatagagatggaaagtggaacagtggctgctgggggctgggaaaaggggaaatggggagttaatgtttaacaggaacagagtttcagatgggaaagatgaaaaagttctggaggtagatggtggtgatgattgcacaacagtgtcaatgtgctgaatgccactgaaccagcacttaaaagtggttaagatggtaaattttatgctacgtgaatttttacaatgaaaaacaggccaggcacagtggctcacacctgtaatcccagcaccttgggaggccagcactttgggaggccaaggtgggcagaacacttgaggccacgagttcgataccagcctagccaacatggcgaaaccccatctctaccaaaaatgcaaaaattagctgggcatggcagcgtgtgtctgtaatcccagctactcgggaggctgaggcaggagaatcacttgaacccaggaagcggaggttgcaatgagctgagattgtgccactgcactccagcctgggtgacaaaatgagactctgtcaccaccaccaacaacaaaaaagtgggcaggatcttagaaggtaagagaaagggttgctgcaccaatagctaagacactcagcgacattcctggctggaaggtgcacagatcatagcagcccgagacatcctcagctgggtgggagggagccacagcatcccaggacaacatgccaccagctgagtgcaagcagaggggctttctctgtgctgctggggctgagccatccactgttgtctacagtgtggctcccagtgccagctagtggaagaacagaagacctcaagagacttgtggaactgggagctctttcccctatggaaaggcctcacctgcagtcataggccagtccagcaaagggggccctgatggcttacaaatgctgcaggaaggaagtgtctgtgtttgctctggcagggcaggtgggaggcaggaaggtgagcacagggcacacctacacatgacatgttttgccaggttggaaaaaaataagtgggagaaaattttttctgactctgcaagcctttaccactttaaatatttattcatcaaaatatgatgagaaaaccaagatccacatagagtcaccatattccacaaaccaaaaatcaggacaaacagccaagagctgggatggagtacttgaaatcaggactgtactggaaaatctaggtcacacggtcactaattatacagaacacatatgttcaggtccccaaactaacccagtgcttttaggatttgcaaatgatataaggaaactttgatcgtgtccatttttactttcttccaaattttggttaaaaggaaaactttcctgcatcctcaaaatttctagaaaattaagtcctacagactaagaactgttctggcggatattctgagggggcctcctcagaaaacatggcccatcaacccccaagaatggcccccagcccctcatggcccagcccccttgctgacagacccccaggctgcagggcagaagcttgtaaggatggacctaatttgctgtgataaattgtgtgcacgcaccagtgatcaaaactgcagctgagaccgattacactttatgattgtgacggttcttgggaaacacgtaggtgtacatccttgccagtccagagagggggtccaacctggcacccagcaaagggtgatcccgtcacccagaaaggcagggctccatgggctgcccactctttggaagctggtcccactgatgaggctgaagaatgctgtggcctggcctcaaatgcctcgtctgccctctcatacatacccagcctccaaccaaacagtgggcacattgtcactgcccagatacctgccccacaatgatcaagtgggtctgccctgtgccccccacttctatcaccaggcagaagtcactggttttcataatgcaaaccaagaattatctatatcgccagtctgtcccatcccactcatctcaccagaggggtgtgtgctttcgtgtgtgtgtgtatgtgtgtgtaggtatatgcacagttttaaagtaaggagagggataggtaagagtgaagtgtgaaattaagagcacacgaagaaggcatccgaaaagctgtgtggttcttgacacgtacctcacactcaatactggagggtgatgatggtgaaagaacgtgtagctggatggatagggagatggatggtagatgatggatggatggataaatgatggataggtgggtagatgggtatgggggaatggatggtagacggatgatggacagatggatggatgggtagatggaggaataggtaggtggaagatggatagtggatgaattggtgagtgggtggatgggtggatagataggtgggtaggtggaggagtgggtggatgacagattgatgggtagatgaatgaatagatggatggatggatagatgaaatggtgtgtaggtgatggacagatgtatggatggatggaaaggtgggtggatagataggtgggtaggtggaggagtgggtggatgacagattgatgggtagatgaatgaatagatggatggatggatagatgaaatggtgtgtaggtgatggacagatgtatggatggatggaaaggtgggtggatagatagatggaaggatcagtggacagattggtgagtggatggataggtggagagatgggtaggtggacgaatgggtaggtgatagattgatagacagatggattgatggatgagtggatgggtggctggaggatggatgagaggatggatgcatggatggatggatgggtggatggattggtgagtggatggatgagtagatggattggtgagtggatggatgagtagatggattggtgggtggatggataaatgtgtagatgaatggatgaatggtgggaggaagaggagtgcatgaataaataactgggtaggacggtaaacgttgatgagttgatgagaagacaatgggctttggagatcaaatcttgccttggctaattactgtctttctgaccctagccaagtcactcgcttctctaagcactccttcactcacctgaaaagtaagactaataatatctacctcattgccttgttagaagcttcaagttagataacatatgtaaaaggttttataacatgtaaaatgctgtatggacacttaatagggtcataactaatactaaccacagggctttgtcatctctgtcaactaaaaaacatggatgatcccacattttttttttggtagatacggggtctcattatgttgtccagcctggtctcaaactcttgacctcaagccattctcctgcctcagcctcccaaagcactgggattacaggtgtgagccaccacgcctggccaataccacatttttgatgtggcagcttctgaggcaaagatgaggaaacaaagatggcgccacaggtcagggctgcagctgtctagactatacctccaggtgtggcctcagctgggaaactggtcactgtgcaggaagcagagagcctcacttgcctcctccgctcaaacactcaaacccaaatgagtagaacacattccacaactcccaccacaagccccacttctctctgccagtatcctactttaatgcccaggtcccaagcctgtattcaagtctacaaaatggtgagagtcaagagcatttctagtggcccctagaatgttgcagaggcagcaatggttgcagaggcaccaatgagataataattgcaaactgtgaagtgtttcaacggggttacaaactcacagtgcaagttggtaataagccaggtaaggaaggccagttgtgggctgtgttgaaccaggaagcacatcccagtatccaaaggggtcacacagaaatgtcggccaggggctgccaggcctgatttatagaaaaatcaataaatccagccatttagtgtggtggtgaagaggacagaagccggggctggtggcctgggtccagcattaaccagctctgaggccttggggggttagttgacctctctgtgcctcattttgcttgtcttcatattagaggcattgtgaggatcaaatgtttttatgcctaccagtgctaagaacaatgccgggcactcaaaaagcactagctaaatgactctttatgatgatggaaattctctgttttaaaacacagacaaccagctaggcgcatggctcatgcctgtaatcccagcactttggaaggccaaggcagtaaaattgcttgaggccaggagttctagaccagcctaggcagcatagtgaaccctatctttacaaaaaataaaaacgttagctgggtatagtggtgtgcacctgtagtcccagctactcaggaggctgaggtgggagtactgcttgaacccaggagttcaaggctgcagagagctatgatcacaccattgcactgcagcctgagcaagattctctttcttaaaaaaaaaaaaaaaaaaaaaaaagtgaaaatagaatatagagaaccctctaaaagttccacaatccccaggccatggactgtgagttttcaccctctgctctataaaagtgttcaatgttataaaaacagtgacttctccttgtgcgtcccttctcccctatgtgaggagagaccgggttagattgttctggatgctcctgaagtcagggagggcaggggcaggcatggttccttatcctactggaaatcccctccctgccctagacaattttagcatcttgctcctcaccttccaccacgcttcccaccaacgctgtattttatttaccctagaaccccaaagagcataagatgctccagtattttatgtatcacaacaaacaaaaaatatgaccaattaaactacagcacacaaatgaggtattgcaacttaatgtaagagaggctctaaggaggaaagctgtgtatcttaaaatacaaccgtgaaataaggcaacagctcccgtatactgagctcctaccatgtgtcagaaactggactctctgctctttatatattatctttacttctcccagttgttcccgtttgaccgatgaagaaattgaggctcagaaaagcaaagtggctcgctaagtcgtctagctggtaagaggtggtacatagattttagcccaaatggccctgtcctaggatgactacctccttccctctcactgtcccctgccactcccatccctgctgtcccctgggacgcctaaaggagacaccaaactgaaactgtcactttcccttgctcatattgcagccacacagtgaatctcaatgcagccccggacaagccccagtccgtccatgattgattctgtctaaacttcagaagcagaatgagtggagccacattattgacacagcaaaattaattttctgccatctcctcttccccatgcccggcccccagcacctcgcctctcctatgagtattggcgcacggctgctgacgggtgctcctgaaatgccaacttgcatttctcatcattaatttctttgtaaatgtcattagtaattgttcctgcttgaccaaagagtacaatccaggcttccacccagagcaccctggtctctcgttgatgggggctaagacatccccagccatgccagaccccagcctcctgatgcaggcagccatccccgctcccaataagtcaggatcacaggctgctgtatcaagaaagttctgacacaaatggagttcagtaacacaaaacatcctgcccttggtgttaggacaatggttgtatgttcaggctgcctgggttcaaatctcatctctgcccaactatgcctcagtctccccacctgtgaaacggggataacagcagcactggcttcataggtttgccctcagaatgggaaaaaaatcaaggcaaaaggattcccttagtgcctggttggtggtggtgctaccatcgtccttcaccttgcctcttaccaccagggttgcaggttcagctctgccacttaccagccgtgggacacgacatcaagcgagtggcttaaactcgctgttgagcctgcttctcccatctgtgaaagagggacagtgatatccacatcaactctgccaattccacctcagatgttgcctcctccatgtggccttcctaggggaccaggcaccatgctcgatgatctacaagcatgatgctgcatccccacagtaaccctccaagaggggcactggcagcccactgtccaggtgacgacaatgagtcaccgtgagggaggtcacatgcccaaggtcacattgacaaagcaactctgaggcccccaaacctcatttctggggggtggacgttgactgtgctccttgtccctagaaggcccaggacacaggcctgaacccttcgccgcaaagcagtaaaaatgaggcagtgcttcctgagtgctgctagggacctcacagcaagcccttcccgtgagtagcttcttacgacctcacatgagtgtgtctccttgttgtaaatgggtaaactgagactccccatgtgggcagagctgccaggaaagcagagctatgagcccaggtggtctgacaggagtgtctgtgtctgtgtctatgtctggggtcttcccctcaggccccaaggccccatgtcttcccgtgtgagaggctccctctttgtctgagtcaatgcggggcagggcttacagggtgcaaacctctgtggatgtggagccggtgaggcgccgccactcgcagtgttgtcactgttactaagaaactgaaggcatgtggtcccggctgaggcagcgccggggaggggttcggctcgccacacacacaatggccaccggcctgaggctcctggcagctcccccgtgcccatctgtcgagatggcatggtgccctctaaagttggttggccccctgccctagggcatgaatgacaggctccaatgggcagacgggcagccggaggctgattccaagtgccatctctgcctggagctgggccttgaggggaggccccccagtccccacctgggcctccacacacttcattgctcaggcgagctgaccctcaaggctcacgagggtatctgagcacagctggacacagacttctgtttcaacactacccctccggtgcccgctcctcactgcgcctctgtggtgaccagggagaagccattgctcacccagggctgtccagaccagcgacagtatcatgccccgggagctgcatgcagcctccatgtcaccctctagaacgcctgcctcgctgggaggtgaggcccacttcgagaccctgcacccagagacctacccttggcttctaagggctttgagagtcatctccaaccccactgcctcagcccgcaggctgcgaacacaggcactcatgtcagactgcctggcctcacatttctccacgctggcagctatgtccacatggggagcctcagtttacccatctatgacatggacctcatgcgtgaggtcctaagaggctacccacatgaagggcttacagtcaggttcccagtaagcactcaggaaatgctgtctcatttgtactactttggggtgaggggctcaggcctgtgccttgggccttctaaggacaaggagtgttgtcagtgtccaccccagacttctcccaaggcagaccacaaactgccacacatggcccctcaggagacacagctgcctccagtagtggcagcaataataatcatgtcaatgacaacagtgatgatgatgatgatgatgccacaccttattaggttgggaacacccttgccccacttgacagtaaataaaccaaggcttagagacacagaccaactgtgctcgtaacacagtaacttacagggagcaagggcaaagctcaggctccacagtgccccttaatgtcacatgggggcccaactgtggggctctgttttgtgtagcacttatgttgtatttagtatgtagtatgagtgatatggtatgatgcagcactatactatactatactatatactataccatattacatcacattatattatattccacaaacacataacaaaaattctgtttgtccttattagcttactttcccctccctgcaacatgtgaggggcttagtctatgcctctgtttgtccccagcacctatgcacagctggcacagatcaggtgcttagtaaacacttgcaggctagattgagcacgtccacacatgattgattgaatgagtcaatgaacgcattaacagaaagcccaccacctccagaccacaggcagggcaatgactagggctcaccaacctttgactctgacccagacccaatgctgggagcttttcaggcatcactgccttcagctaccccagtaccaaacaaagaagggctcttcaataaccctggtctcttgaaagcaagagaatgccggtgacttgcttatggtcatggagctgcttggtggcagggctggcatctgaggccagactgtgagctccacagcatgggcatggcatcgccacaacatgtggtcacattcagtagaattcaggctgtgctgggctctggtttcctaccctagtggggaaggcaggaagcataaagtgatcctattggaaaagggccacaatgaccctcagcaatccttctatcctaagtgctataaagtgctttacacatgcgaactccatcttcacaacaacccgaggcagcaggtcttaccccatttaacagatgtggaaactgagcccagagaaatacaacatctgcagtaggaaataatgggcggctgggcacggtggcccatacatgtaatcccagcactttgagaggccgaggcaagtgggtcacttgaggtcagaagtttgagaccagcctcgccaacatggtgaaacccctgtctctcctaaaaatacaaaattagccaggcatggtggtgggcacctgtaatcccagctactcgggaggctgaagcaggagaatcacttgaacccgggaggcggagattgcagtgagccgagatcgtgttactgcacactccagactgggtgaccgagtgagactctgtctcaaaaaaataaaaaagaaaataatggggattgggagacttcggggggtcagcagccagcccaactctcagccctccccaggctcctggcctcacaagtggctgactccagcgtgagcaacaggttctcactccctggaaccaccactgggtgtcagccagcaacttcaggccacacccatctgggccctggtctcccagcagaagtcaggttgacaaggatggggccatctctaaagcaggaaggaggaagatgccgctactcacagaaagcgcagccagagtcaaatgctaagtatgtgcctagagcacttttgatttttaattattattagttataattatctggctggatccaacagcagcagtacaaagagacaaggaaactggctctttggttacccatcttataaggaccagggattttaaaaatgggctcccggaatctgtgggtttccccttcttccttttcctcctttcctgcttgtgttctctttccgactttccaggagctcaaaaaatatgttaacacatatggggatggatggatggatggatggatggatggatggatggatggacggacggatggcaaagggtgtcttcactctccaaaaactcacgtcagagtggagagtttggtgtagacgtagtgacttacaatccatatggccaacggaatcaggggggttaaaccaagggctggagaaaccaaaggaaggagaatccgagaggcttctcaggggaggaggcactggagctgggctgatgcattaagagaaagaaagggtacttcctgcaggcagataggcaggtgtacgtgcatctaggaagccccatcttgatctcactgggtaggcgatgcgaggccagcccaggagaataatgcaggaaggcagtggccgtctgtcctgcttgcccctctagtccctctgcctttttattctgttctgagaacaccccaaatctgcttgggcctcagatacttggtactggctcttccctctcctggaggatcccccagctcttccccacactggctctgcaacctccaggattgagctgaaatgccagcctttcctgaccacccaacacacacacacacacacacacacacatgcacacgcacatgcgtacacacacacgcacacgcacacacacacacacatgcacatacacacaccactctccatcacagtacagcgttttcacattctgaaatcccctagttcatgtatttactgacttatcatcagtgtctcccaaagcatgtcagctccatgagaatagaaaccctgtctccttgttcccagttctgtctcaggctcctgaggtggtgccgggagtaggtactcagtaaatggaatcagggcaagggctgaatcaaatgttctcaagggctaggaaggaagggtcccaagggagctgagatcccgcccctgtctcagagagctctccctctggccgggtaccaggaccctgcctggcagagcccggctcaccctatcgaaagggctccgggttgcttgttagaatacctagctctgcttttaatcaattgtaatcatttagctggaagcagcatgattaggcacacacaagcaaacagcatgagctaatcctttaaatgcgcccgctcaacgctgggctggccgctttgccaccgcgggcccggctcacggaatcacttcctgcagcccctggctttgtcaatgagggagtcaagattccagggcgtggcgctggtccaacaccccaaaaccatcttcatcaaggacatgtgcatgtgtgcgtgcacacatacacgcgctgtgaactctgacatgccctggcaggcagtgccccacagctccaagatcccagaagttctatgtctaaaaagacatctctctagttcaagttctattcccccatgacaggaccaagcaagtcataaaggggagaaaggtggcagcaccatgaacctgaggtcttaggaagtccctatctccgtgacgagaatgaatccttcctctccccaagcccagcctaagccaaacccatcctgatgctcatttgcaagcaacagggtttgcagggtcctggcctcgagctgcagcctggcaaacgtggccatgcacagccctggccccgcgcgcacaggccccatggcgttcccacctgggctcacccaggagcaatttttcttgcatcccctgttactgctacttgtgctacctgcttggcccaactactaaaatagtttctgggtcccctgacaacgaaagctttttatagttcagcactgcaggcctcatttaaatctattagctcatataaatggcaatttatttaaactttggagggtttctgtttgccttggtggcaaagacaatccagctttatgtgtggctctgccatttgcaaatgaccctcggcaaaccgcttaacttctcagagcctcagtttctgtatctgtaaatggggatgagagtaccttgttcatagggctgtacacaatccatgcaaagtgctcagaacagagcctggcccgcagcacagacctagggcccaggggtgaaggccatgagaattgtctctggtacaatttcaggggagcttgtccactgtctaactccagccctgtatggctggtaagccgcatatgaccctcatgcacgcatccccacagtgaggatgaagaacaggaagcagcaaggctcttaggatggggagatggaggcaccatccgtgcccagtgtctgtgggcacagaggtgcccatggggatgcagagacagctgggctggtgggcagaggcgacccctcccctcagggtggctaaccgctggcatggggccgatagggccccaggccttcatctgctgaggcctgaggctgggaatgcaaggccaacagctctgacatttgcgggctgtcttgcacccccagtcaaatctacataccaccctccacggcgcccggacgtggctcagaaatagagggtcctaagaaaagagcccaggtcaaaggcgctcagagaagtaggggaagggggacccgaagccccggccctctggcctccattccatgccctttatgccccgtctcactgccctgggcacctggctcctcccaatgccccaatgtggggtctcctgtgcccacagccctgaggcttggtgggatgccacacaaggaaggacttggagtctcactttgttcaaactcaggctggaaaccatgaaagcaaagcaaactccaaggagagggaatccccaaagccatctgatcctcaaactgcccagaagtcaatgtcaataataatcacaggcagcgtctgctacatgctctgtgtgccagccactgtgccaagggccttttgcaactgaactcttaagtaggaactactcacacccctgccttacaggtaaggaaactgaggcttacggctggtgcatgacagagcaaggttttaaatacggagctgccctcacaaagactgggccgctccctgcttcactcttggcagcatttcagacacgtgcattgtttgcacacttctaccgacagggacctcagcactttccatttctggacagttttcccgcatactgcaaatgctcagtgtccatccaggtcatgcaccccttccctgaaaagcaccctgaacttgctggtttgtatcatatgatcctacccccagccacagctcactggagcagggtggacagctgacccaggctcacctaccagattccccctccagggatctagcacctgttgcctgagggctggctgccaccgctgtcactatctctggggtttcctgggtgttccttctggctacctgtgtcaccaatcctcacactaaatcctctctgttgagctacctagggtgtctgtcttagcagaattgacaggagctgtggaaccttgaccaccttcctccttgtacagaggagcccagaaagtcaggctgtagagagagaggacaataaaagccagaaagaggcagaaggcagggaccaggcagtcttagagaagacagagtgtagctgccttatttaagtgacacttggctccgggaatagggctgccaaaaacccaacattgcttcctgctcttagcatccaaaatccactcatgtccctacagcttaatttcccttctagcttgcgccaactgcagagagtgatgcctgagccatgactatccaggaccaaaacccctgttctgagttggcgcccactgccaaaagtcttggagccacctgaagcaataagaacccctccaggacccagagttcttaaaatgctcgaagacaactgtccctgcatttcttctgcaatccatccaagtcttctcctggttaaacagacttaggacagactcctggaagcacctcgaggtcagactggatcccctactgcctgggttttcaaggtgtggggtgagcgtgggcaggtgtatatgtgggtgagggtacaggtatatggacaaagcttagtctcccctatttctttttctcttgctttcaagtcataggatttattttgttttgtgaaattgaaagctttaagccataacaaaatgagagaaaactttttttttttcattgttagatcaggccagttaatggtgagtttcttggtaatatcctttctccaccctatggcttcgaagttatcacttgggctactttaactctgtgactcgttgttgttcctgctgctgtcttctgagatagatatgctgcttactgttcccgctttgctccaaaatctcttcattttattccatttaagactaacaatagcaattaaaatgagcaaaggtaaaaaagaaatgtagaaactgatcaaaagaccattgtttttaggagcagcacgtcgttttggaaacaaggtacacttttttctaccgtaagctaaaatccatcattaacacttcctcctggtgatgatattggcggctcacaatctggaggagcataaccaggatcacactgacaatggaaaagttcattgcaagccctattctctctgcaatttatgttatatcttgttatatttatgtcactaagatatttgcatccttggaatctacataacctgtgttgaccacatgcacttgtagcttctgcataggtcccccattattttgaaccatttcttgcatgtgcagacaaacatacatgacccccaaggtaagtatattgtatatcaaagtctgtcattgatactgtttctgaatgtgtccagtgacaatctttccacaaagaatatcataaaaatgacaacgggaaccacagtttccaaatttgtcatttagaaaattcactttttctgtacacagaacactagcagacttagaaaattttccaaataactgtgcgcactgtctgtccctatctctgcattctcctttaaagcaatatctagtcttattgctgcagtattctaaatcagcagctttcacatcagttacacaaaactcagatgttccattgcaaaaaaaaaaaaaagtctcccctatttcttccctgcaactccgaccttcagccactgacaactactggtctgttttctatggcgatatatttttacctttttccagaatgtcatgtcaataaaaccatacagcatggaaccttttgagtatggcttttgtcatgtgacatttgagatttatccatggcaccagggacagtggctcacgcctgtaatcccaacactctgggaagccaaggcgggaggattgcttgagcccaggagtttgagaccagcctgggcagtatcatgagaccccacctataaaattaaaagttaaaattaaaaaattagctgggtgtggtggtgtgcacctatagtcccagccactcaggaagctgaggtgaaaggatgacatgagccccggaggttgaggctgcagtaagccatgatcacactcctgcactccagcctgggtgacagagccagaccctgtcacttaaaaaacaaaacaagattcattcacattgtaacatgtatctgcagttgccttttactgctgagaatgtacacatgacctgtaccaatgtaacacatgaccccatctgttacccatcctccaaataagggacaacgagcaggcctccggtttggggccatgacaaagctgttatcatcattcatgtagaggtattggtgtgagtgtaaattttcctttttttcttgggtaaacactaagagtgggattactgggtctaacggtaaatgaacgtttaactttataagaaactgacaaatattttgtcacatggccataccatcttgcactgccaccagcaatgtgtgaaagttcctatcccgccctcaccaactctcagcattgtgagtttttcatttatgtgggtggcatcaggctatggttttcacttgcccttccctaatgactaatgatgttcattttctttggtgagacatctgccaaaagatttttgctcattttttagttgttctgtgtcccgtctcattatggagttttgagagttcttcatatagtctggatacaagtgctttattcgatatgtgatttgcaaatattttctcccaatcagtgacttttcattctcttaaccatgtctttcaaaagcaaacttcttacattttgattcagggtgtaaatcagataatatctgtcccctgcttggtttcccatcatgatggagataaaatccaaagtccttcactgtcctgaaaaccttgccatgatctgggctccactgcctctgccccaattcactgtgcttcagctgcactctgccttctgtcatcctagccctggcacccagtggccacagggcctttgcactcacggctctcttccacacaatactgccttcatgccatcgggcctcagcttgcatgccacctcctcggggaggccctccctgaccacacttaccaaggagtgtctgacttcaacctcccagcatgctctagcccattatttggttttatttttttcatgtcattggctcttattggaaagtgcccatcaatcccctagaatgcagaccccgtgggtatttcttcatcttttcaccactgtcttctcaggtgctagaaacagggcctggcacatcatgggccctccacatacttgcttcaaacaaatgaataggaaagctagttccctctcatgttcctaattattcggttgtgaatttgcaacagtttgtctaaactcctttgaattaatctcagtcttttgggcagagccctccgaacttggaatcaaagaggactcacacctcccttatactggcaactgtgctcctgttaacgcaacctaagaaaacattacgtttggagggagacatgtcaatgttgacagagaccaagcctgtcatggttcagttctacctcctaaacttctattcctgcagcagcacttcctggtcctgcagtgagctcaatcctaagcctagaatcttctcaagacctctcagcccatagtcccttgtgcctgcaaataccaggtgcctggaatttccgtgcataacctcaaactacacaaggccacaagaaaccagcaaggatagaactccagctggccttgcctcccactgccccacccaaacccccagctcattccaagaaacaacagcacacttgcctgttccacccaaccagggccttccagccccagcttctgtgtagggacaatgaacactccaatgcctgaaaaaccctcctctcaaaaacgagaaaattgctattcaagttacttaacgagagccattatttgcatagatttggcattgcaacaacacttccgtatttaaacggtctataattaaaatcattaattgcagaaaatagtgactcgttaaggctgtaatttagcggtttctcagtatttgaggatctgacttaaagcttaacgggatgacccaggaaaccaccagctcacatgaaccgctctcaggtcaagtgtggcccacagctcgagataggtgggatcgaagcaagatccagattgaaagcagcagcctccctccacctctgcacttatgagctaggcccccagcccagtgacaccaatgaagctcaaaaacgtcaggatgggaaaccttctctgggaataatcttgaggccatcagagaagagacctcttggcatttgggacaatgcaggcgagccaggcaggagctgagcaagttcaaagtgtaaataaatcgtagtttatatgcactcacgggtttaaaagaggcctgacctgttgggctatagaaagcctcctctgtcaggatacccaggcctattttggtagctgggccactcaggtaaggcaggtaggataaggcggctgcatggactgcacttgggagagggtgcgcatccagcacacgagcagggaggcttcttggatggcatcaacgcctagctgtcgccccacacatcctaagcacagagacatcagctcagtttgtggatcaatggggagacagcagtggcatggtaagggtcactagctcagtggtggccttttggaagtggaaccccctctctgggccaggtctgtatgattggtttcataactctgtcccacgttgtgacaatgggataaaggcctcatgtacaatacacaaatttatgagcaccgtaaggatgaaaagaaacaggctttccaccacaccagctgggtgctcctcggggccagccctgagctcagcctacctagccctggcatggggccagcctatggaaacaggacttgaccatctaatggtgaatccccccggtccccacaccctccaagggcctgtttgcatatcctccaggcaacagccaccaccagctgtgcagacaggcgggcccaggcctggcagtgtgggtgggccacagcacagtaagaagggggccccctacaacaggccacagctgtgcccctctaaccccagagggggaggcaccactgtggccattcaagtgactctgcatggtgtaagtggccccagccttgtaacctgggtatgtgggagattgctgcatgcaggtgcagcagtggcatggggatgagggagggtgctgctgggtgtgtagggtcccccctggagggccaaactggtgtgtgtgagtccttagggctcccttctccttccaggcagagggtggaattccctgcctcacccgctttgaggttgggcatgcccgcgggacttactctagtcaacacaatgtgagagaaggtggcgtgcatcatttccgaggggaagcttgaagtgctggtagagaagtcaccacctccctcttctccctgcctcagtgactacggaaacgtggatgggcatggaccctccgtgggcctgggtcactaagtgaatattatgaacagagtctcttccccatcacctgcttggatatgtcacatgggcaacaaataaaccttttgttgaggacacagagaccgagaggaggtttgttattgcagcctaacctacccatatccttcccgacaggctcattcttggtatgtgacatttcggcatgtccgtctatgtgtatgtgtgatatatctgtggacatgagtgtggtccttcttttgggggtgcagtgttgtgctgcatgtgtgcggtattcctcagggtggatgcagtgttactctttgtgacatctctgggcatatacactgtgataggaactgtgtgcgtgcaccttccctttgtgtgtgtgatgctatggtccaggtacagtgaatgtgagatttttctgtgtacgtgtgttgtatttctggtgggcatgtgatctctccagtgttgcaagaattttttgcaaaaaccagtgggagagaaagcagtttcacttgggcacagatcttgttccttggaaaaaccagtaacaggtgaaatggggccccatgggattccaaggcaggtggctgtgaatgcctgggaagaccgtcacaccagcttcctttcccaaggtcctctcagttaccacaggctggggatgaggatgcaaggaagttggctgaggcccctgtcccttacctgagggccacatcagtctcaggacctctggtgactgcctctaagctggggcaatcgggcaccactactcttcttttctggcttttatggacaaaactggaggctccaaggccccagacctaactcctgttcccacacagccccaggacccagccacaaagacatcatgggcttctagccacagaaccaaagctcagtgaaatatcattttacaatagaggtagggaaattggaatccccaagagcagacaggacttgccacgaaacacctcaaatgtaagcttctgactcctgctctgggctcagccagtggcagttggttcttttgagaacgctgggctggcagaggccagggggctgaaactccatgcctgctagccaggaggtcagcccctgattgcagacctgccagcataagactccaccagcttgccttaaccctgagaccgtcggtgctgacgggggaaccgaggaccatcaggcggcgtggtgcagcggatgtgggcacccacctgcagctcggtctggaagaagaacttctgagggcactgtgagcagtcgtagatcttgtcctcctgcccgtgcacggcaaagatgtgctgctgcaacttgttggcctggacgaagactagacacagacacggctgtcagggccaagctcaggacaccagcccagcctcctgtggcagctgcccccacaacactcgcaggcagggatcactgtggcataggtacagtcagccaaacagtgggctactgggagtgttcttagcacatactagaggaggctcaagttagataagctgagctccggtacttagtggctgtgcaaccctgggtaagtcacttaacctctctgggctccatttcctcactcaaaaaatgaagattataatatgtccctagctgggtggctgggaggatcaaatgggatattgataaagtgcttaaaagatggcctgccacagacaaatgaatgctgtcttcctcgtccccatcatcaacagccagacacctacaggggtgagcttcttgaacccctcccaggcctgtaggacaggtgctattatccccattttatacaagagaaaactgaggtgccaggaatgttaaatggcttgtccaaggtcccactgctagcaagtggcagagcctagacttgaattaaataagctcagcacagggtcttgtacaagaagttgctcaaccaacacaaattcctatttttattgttgtcagcatcctcgggcccccacacagaggcccccatgtcctgggttggcagacgggcagctggggcccttcagtgccagcctcagagtgtggcagtgacagatgggtgggggctcctgcgatgagggggaagatggcatcagggtgctcaggggctctggggagccccaggggtgtgtgtttgggggatttgccccagagtggacacccctgggcctggcatggagaaggtctagccctggcttcccagtggcaggagttctgaggtggccccagccctgagcgcacccaggaggtggcccagagcagctgtgtgtctgggaggtgagcacttcagagataccctcctgccaggcgtcctccccagggtgggcttcctgccgtggcagacagcagatgtcgggggaggcagggaaggccaggctctcccacgcacaccggctgccatctgggcagcaggagggggccggcagagcccctgagacttgcctcgggctgggacagccattcgcctgggccggcagccagtctgggggctgggaacttggccggcagagctgcccttgacccctgcatcctggagcatggatgggagctaggtaggccagggaagggggaaccaggagtatgtgaagctgggagccccagaagtgctgaatagagctcaaggctcggggagacaaacacagggcccgggaggggaaaactgccgcagagggttgaggctgggttggacaaagggcttctagctcctgtgtgcagagggcgaggagagggtgccaaccagcctgctgatgaggagaggccagagagcactgaaggagggcgcgtgtcagctctgaactgagggacgtggggcaaagggcctgttaatccctcagggtatccccaacggagtcctggtctataacaggcctgccaaggaaagaggaagagcacacactgggatcccgcaataacagggcagggctcctgtgttcatctctctcccctgaggggcacaagctgggtaccttacctgtgaaacacacggggcatttgaaggtgccgcccatgccctcgaagctgtgctcaatgaggtgacagaggagcttggccggggagtcgaacatctggttgcacagcttacactcgtggttgatgccttcctctgcaaggaaaacccgtgaccagtcagtgaccagcatgccatgtcccccagacaggtgctcacaaggcctcccatagaccccagcactaacccccctccaatccccagcaccggggctggtgaagggactgcagacaccaagactcatcctggctccacatggcctcacccctagaggcttacagaccccagaggaccggctccaaatatgtggcccttggaggtgccatttgctgtgatttctcctgctgatcaagcagccaggtgtgcaggccatggtcaacagcttgagtcccaagactgggtcactgtgcagaggcacccaggatgaggtacaggatggagaaggtggtccaaccaggattttaaaaaatccaatcaaatatttattgagcatgtactatgtgccaggtactttgctctaaggattatttaggcaactaaacaaataatgtctctgcccccactctggtggtggggtagacagatgataaacaaaatcatcagcacataatgcagtgtcaggaggtgatgtgaatacatggcgagagcactctaggagaggggtgggggcagggccctgaggtgggtccatgccatgctggacaggcttgaagcccagcatgggaacacagtgcctgagctcagagggccaagagtgaggtcagagaggccacagggatgcacaagaaaagccctgtcagcccctggaggactttggaattttacttcgagactgacgggcagcatggaagatactgcaccaaacgctctttttatttgcttttcttttaaacaaatggtctatgcagtggatgatggacaacaggcaaactcgccatcctgcttcagaccagaacacagctcctccatctccccacctgggagccgctgagaccccaaaccttcacccaaaggcgccgggggacacagagtgcctgagcaccagccttgccaatgtcgaggaggctcagagctctggtgccctcactcacaatcaagcagcagcaggttcaaattctggctcctcagccccacacagcatgctgtgggcacaagctcatgtgcagtaagatggggaccacctgtcctccctgcttcccgggctgcaggaggacagaggggcccaggggtcagtggtggggatggggaatcccctggtttgagcttcacatcacctggggttggaatccgtccctccccttactgggtgatcttaggcaagtcacacaacctctctgtacctcagtttcctctgtctgaaacactccataacagcttttctgttatagttgctatgagaattaaatgagctaatacatgcacaggggtctggaacagaccctggcacacagcaagtgctcaataagtgtttactgccaggcatgtcagtgttggtgagagtattatctgggacagccaaggacacgggttcccctttgggctcccccagggaaccagcctcactgaaggcgccaggtgctctgatttgcccttaaaggcaagaattaggtagcagaggggttctgctggtggcaagacatgaacacagatgggctgaggctcctggcgagtccctgggtccctaggccctggcaggggctggcagagacagcaggcattccccctggcccagccatcccccgcacccccgggcaccccaccgcagaggcgcacacacacacgtgcacacacaggtgggtctgccccacatagcccactggctggaatctaccgggtgtttgtcatgcccctggagccctggcaactaggccacatacacccgacagagactcaaacagatcttccatttatactagcagaaaaggaattcattgacaagttttgggacacagggcaggctcagcacgctcgccctgcaggccccacgcacgtcctccacctcccttggggagacgttcatcataattagagatggcctccagtgtggggggctgcctcaaaagaccccccaatgcatcccctgccccctgcacaaacaacattgcccagtgcctggcacagggtgtaggatcaaggaaagaaagagactccacccttacatgtgaccttattagaatgaggacaccccgtggacattaaggagggagggggtatgtgaggttgacaactgtgcagagttttctgtaagaatagtttataacatatttcaatctcagaaataacccagcttacttggaaaactgcatttctgggaagaagaaatgggttcggagaattagaccatttactcaagtaacacagccagatgggggcggtgcagaagaggatacaaaacctttcctatatgcatgtacccccgccatcgtacaccaccgccaggcagcctgccctgacttgtacccctcattgtacatgacctccaggcagcctgccctgactattccagttcatgagcacacacacgtgtgcatgcacacacacacacacgactactccctcactaggcacaatgacccttgattcatgtaaccatgtgagattttctgggcttgcctgcaggaggggcttggaaatactcacagaggagagacgtccccaggctgggccctctctccctgcccagctaggggctctgggggctgagacggcaaacaggatttaccgctctctgccgagcgggggcctttaaccacttggctgtgaatggcgacgggcccatctgatacacaaacaccgagaggacaaagaagcctcctgcaacttataaatcagagaaatcatgtctgacagtcactttccgttctccgagtgccgagcaattcatcagctggtcccccctgattcatagccgcagctacacccagcgcccatgttcataaatatgtgcacagtcaggcagccctggagctgcaagccgtccggggcccaaacggctaccatttaagcagatcacagccccaaaccagtgtcaaagtaaggttccaggctaattagatcaagagcccaacagaccactgtgtgtctcgggaccctttcctctctctcccccaagtgttttaagagagtcaaacctggggaaagaggggaggagaaataaaacaagcaaaaagtgaaagtgaagggaggggatggaataaagcctgaagggttcccgcagagctgggactcgctcccactcaaggcaagaccttttgatttgcaaatctttctgaagacgaggccttctccccactggaggggttagaggtactcccttgggtgtccattacgtgtatctctgcctatgaaaccatccaggaaaacagggggagggccggggaggtggagagggcggggaggggctgccctagttagtgtgacaaacactcctttgcgtgctggtgacccaatgtgagccagcccatggatattgatagaatttgctagcaccatcactctcaccccgcaggcgctgacaacctctcgttccaccccaagatgcagggtccgccgatagtggcaccctccgagaatcactttcctgaattatataagatcgcacagtgctcggccgacaccttggagcagaatgacaaagctgtctgggagcctgcaggcccctccaccccagcgtggggactggaggattttgtgagttaagacgcacaattgcttcccttccttttctgtgccttttttttttttaatagcacatgacaggcatccataagacagacccacacaactcaagtgaattatgcagccccgctcatttgtaaagtgaaatgcagatttcacctgctgaaattcagatcttgcctcctgttccccataagtcgaggctggcacaaggaaatctattgatttattatgattaaaaaaaataaaaataaataaaaactcaaactgccaaacaaacaacccgccaagcaggaaaatcccaaagtccctgtctctcctttctccctcctctgctcaggaataagtgttaattttacacttcatttctcaaaaaaataataggatgtgcttttgcttaaaaccaagtcagcctgctggaacctttcaggctgaaactgtgtcagcccaaaagaggagcagagggctttgtggaagagcatcgtgccgagatgatagctccctgtaatgtccctggtaccgacttttgtctccaaaagcatttgatccctggcagacacatacttatttccatacgggtcttgggggaagccaggaggagagagagctgattatcagaatcctgaaggtgaagctcaggtgggccccactgatgtcaaaggcaggcctgggcacacattcggaggccataatttgctgcctgggagggaggagcggcgggctgcagcggggtgtggacggggcattgttctcgggctctggtgcactgagcgtgacctgctccagccacaacggatagtccctgcctaccccctctcttagcaggaacccccctcgggaaagctgaccccagagtggcatcattaatgcacacacctgtctaggagaagaccaatgacttccgcctggtgttgactaggggcatgactagccacctacatccaggatgtggcaatgaaggacacaaaagctagagccgggaacacttgggtttgagccctagttccaccactcactcgctgtgtggactggagtaagttactttgcctctctgagcttctgcttctgccactagaaaataggcagagtcattacggggcttttgtatggcagccaagcagtcttatttggccacaggacatctgcccttgctgagacccccagaccatcccacactccttccctcactacactcaggggtctgcctaaaggacacctcctcagggaggccttactcgagacccccatctaacacagcacacacccccgtcctttccagcacctggcccacctttaattcctggatagcgcttactaccacctggtatattacagggttcattgtttaattcattctcattccctccgtccctccctccctccggcacacagacagagtaacataaactccatgagggctgctttgcccactgctatgtcaccagtgcctagaacaggatctggcaccaggagacgcttgacgagcaggaaatgaatgatttatgtaaagcacttagcacagagtttgcggtagggtgggagtgctggtaaatgccatcactatgcacccatggtcacccctaatctcacaggactcggcttgtaaaaacctcaactccagtaacgctttctggaaccccacggaacaacagcctgctccaagactgagggcgtggagaggctccctcagctgacagaagaggaagggacgcttagagaggcagggcccctaacagggatgtggcagggcagagcagggcagagcggggcagcagcagccctgctgttcacccccagcagccctctctggctttagaaaattcaagaaacagccacaagacctaaaacctgggacccagcaagccacccctgctccctgatcacccaaaaaaatcctggtcagaaggaagacagagccgccctccgcatctccatgtttgagcctggggggtcccctcgccagcacaagcgccggttggcagcagggctggggctttccctgaggaaggggaggaggtagccctgcatgtgacagcgtgggacagtccaggctgcacctcctctctccaagagtgtgtctgcaggtggaagcaaggcagggaatacacaggctgcttggccaagctgcggcccctccactaccagccccagaaataaatgccccagactgacattccacagcaccagggacagcctgcggcctgcgcatctagtatcaggtcaagtcctgaggtcctggggctcagacacacacactgtaaatgggcgcggtaaatggtccttggagagaggaagcatgggagcaaaggccccagcactcatccaggcaaatcttgccaggaggcaagagggtgaggtgagggtgaccccaggagaggacccctccgacaccatccccatagataaccacaaatagcgcagaacaggagctaggaacctgagctgtgggagactctgtcctttgtttcctgtaagaaacaaagacccccaggcagaaagaggagggcaggtgataatatctgggcagccagattgggccgtttatctattgatctgtcattaaatgccatgaagaaattaaccagtccaggctgaagggaaggagagagtgacatttaggctgggagtcaaccagggtcataggagaactcagggtctgaggagtgtcccttgtcaaaggctgggcaagagctgggagcaggtgagtggtgatggaggatgaccatgggagccccaacacccccagctctggcagcccacgggaacccacttccctgccaagcagcccgggcagcacctgggagcttgagagaaatgcagagtctcaggcctgccccagagctgcagcattttaaaggtgcccccgtgtttggggcgtccattaacgcttgagaaccactgagcgcgatacaaggggcttagggacgctgatattgttggaatcctgctgtcccgaagctgggtttgggagctgtcccactgctttgaccaatattctatgtggaaggatctcttaaaaggcaggaagttttctagtcactttttgtccacattttgcaaaagactgaaaaatcgtcagcaatgaaaaatatttcctgtggttactcctgggatggaaatgatgcgagtatatctttgaagaggctgctggagactctgacggtgggtggctaacactcccccaaaccatccccgcatcacggctgtccccgacccccagtgccaggggctctccacccttcggtgtcctcctcactcaagaccgctcagccatggcttgaaggcacagcccaccacgctgctcccattttgggctcacattttcctaattaatgctggaggatgggctgtgcccttcctcctccccctgggggcaccctcccaggccattctgcccagaagggacccatcgtatggtcccctgtgtttcacaaaggcttctaaatgagctctggcagcctgaaccgggccccacgggggacccagagcctcttcaaaacagagccctgacaattaggcagtctgagttttgaaaggcttgggattgatggtgtggacagtaaaaacatcacctggggagctgggtgtagtcctccgagggttgcctgaggtcagttgccatggcaacggagaatgagctcaaccttgtaactgacccttatctttttttgatctgtgggccacttggggccagggcttgaaatcaactggaaaataatccggtcacatatcagaaagaaaactatttatacttatttacccaggtacccaccaacgtcccccttccacaatgctgtcgacaccgcaataaaccgacatcgcatgtgcaaacgaacgctaccccatggcaggagaaagggggagaccgaatgccccatctgggtagaatgccaattccacgcatgggcacgtgggtgtgggtgggaagggtcaccccccaccctgcagcctcgcccttcatcgctactgaccacagcaagactggactctcctgccttccagcatctggtccaggcccaccaagggacggcctctgcgatctgccctctcgcttgctatgcaggcatgtggtttcagcctggcttgatcactaggttgtcttccttgattccagcatctgacaagtctcccctctgccagaggctggacagagaggccaggtggaagttcatcactttctacacctgggggtcgcaatgggattcggggaacgaaggctaagaaaggaggaggacagaggccttccttcctggtcccacacccgaggaagggctggctgcctcaaccaccccagcattcaccccagggtttccatggcaagatcggccatctggccaaagcctgtctccaggacacagctctcctaagttataagtactttgctcgctctctccttctctgaaactcaaatcagaagactccagatggttccactgaccaactgctcccaagagccatgtcagatggatcttagctaggggtcagttaagcttgagaatgatttctggtaaactccctgtgagatttcccatcacagcaaacaggacagctcagcggacggcccccgactagcccttgtttcatcaagactagatccttcagggagtggggaaaaacatggccaagaaccaggctgcgcggaggagaatcctggctctgctgcagatgcccagggtgacactgggccaagcgcttccctctgtgtctcagtctctgactgtgaaatggggagaaggttgtccacctcacagggctgttatgagagtaaatgagagccaagtaaagaatatgaagcatgacccccggcacagtggcttacacctgtaattccaggactttgggaggccgaagcaggaagattgcttgaccccaggagcttgagaccagcctggacaacacagtgagaccccatctctacaaaaaaggaaaaaattagccaggcatggtggtgggtggtacactgaggcaggaagatgtcttcagcccaggactttgaggttacattgagctatgaaccattgcaccccagccagcctgggtgatggagggagactctgtctcttaacaagagcacaaaaaatttttaaaattaaaaaaaaattaaagaatactgatcataatgctaccaccacaactattactgctattgttacttctccttctttttttttgtttttttttttttgtttgcttttgagaccgagtttcactcttgttgcccagctggagtgccatggcacgttctcagctcactgcaacctccatctcctgggctcaagcgattcccctgccttagccgcccaagtaggtgggactacaggcgcacaccaccacacacagctaattttgtatttttagtagagatggggtttcaccatgttggtcaggctggtctcgaactcctgacctcaggtgatctgcctgccttggcctcccaaagtgctgggattacaggagtgagctaccacgcccagcctgccattgtcacttctgacatgactctacctgaaactccatgctcaggcctggtgacatggcacatacaaacccgctgtgggggccatcaaggcaatagaaccctgctcctctttcagggcatatggccagccatgtccatgcccctaccccagtaaatgtttaaagacccttagcacctgggacattgtgtgttctctcatggcacgtcctatgctacttccaccttcaaaatgcttctgtgtcagctttcttcatctccctcctcctctacctccacaccactcccatatttgcgatggcgaaactcgtgtccagattttaagcccttttgttcccttgtggctcgctgcagcttcctacttcgggccatatgagttgactttgcctcccctctgatgctcttggacccaagtttcccatttctttatggttcttcttgcttctctctcttgaaattccctgagattttcatgaaggtcagagcagggcctgactgagtcaggggcgtgatcagctgcatgcaccccccaaccccttggcccttggccagcccttccccatagctgggcccatgcagaaatctccctaacctgaaaggcctcagagcccaaaaaccgcagagatcggggcccagcctggatgggattaccagtggaggctccttccagctctgagagctgattccacactgccagggagctagcactgaggtgcaagcagccctgggtggttaaggagaacatcaccatcacagagggtcctgcttgctaacttcctatgacgctggcggacacatccacctcccgcctctctgagtgatcagcaattgctcagagacacatcattagcagacacatccaaatcccggctctttgagcgatcagcaatcatgacgggtggtctttggcaaaagaaaagacaaagatcaggtcccggacataacaccaagagacaggaggtaactatctcagcttcttaatagaaagagaatggatgtctgagtgatgaaataaaccacacacaagagaacaagcgggacttcactgagaaccgaggaaagagaactcttggagttctatacaactcagaacttctctgcctgcacattttcagaaggcattccacagccctcctcacacacatccccttttacctgtaaagaactgaaggctgatcacctcagaaaatgaagattccactacatcctggggatccactaggtaaaagcaagtagcttattctttcttaactcatcaaacacctactgatgtatatcactgatcttcagattaaagttttcaacaagacgattgcctaaacatccatcatgttaataatcctcagattaatggcctctaataatacacaattaacatgacaggcaggttgcaaaacccttattgtcaccgaccctgccagggacacatgaattacccctgcttctactacaagggttttctctactgccgacatcattttttgtccccaccaagatcattttttaaaatgagcaacagcaatgtgtcaaaaagcctgacagttaccaacgggcacacacaaacacaacacacacctgcagaatgcaagaaagcaacatttttcaaaagttccccatccaggtaaatacagacagaacttttcctgcagttactagtactcaaagcaaaaaacccccagagttcagcttggaaactggaattcaccactttctcaaagtccaccttgacctgggtcactggacaccaccctccagctgaaaaaaataaacaatgagactagaaaataatgactgacttctattgaaaagctttaaaaagtagatccacactgtcaatctagtagttactggccacctgtggctctttagtttctgggtggtttttttttttttttttggttttttttctgggacagggtctcactgtttgcccagcctggagtgccatagtatgatcacagcttagtgcagcttcaaacttctgggctcaagagatcttgctgcctcagactcctgagcagctgggactgccagagtgcaccaccagacctggctagatttttagtagagatgggatcttgctatctttcccaggctggtctcacactcctggcctcaaatcccaaagtgctgggattacaggtatgagccactgtgcccagcctgtggctatttaaatttaaattaaagttgaatatatttaaacattcagttcctcagttgcaatagctaatgtggccagtgactaccactctgggtagtacagaatatttccatcattttagaaacttcatttggaaagcattgtgttagaatacaggcaaggtgagggcaggggctctccctgtcttattcaacactgtaatcccagaacctacaacagcgttgggcacataacaagtgattaacaaatatttattgaactgtggaatgtgagtgtcaaatattatgaagaacacctcagcccttttgctgttagcacttgcttgcaattgcaattgccctgcctgagaaaccacttagatgtgaacttctccaacgttcaacataaacctacaccctgataattatgtgggcactttgcccaaagtgggtaagaatatgacgaacacaggaacactgcagagccatgaagtttctctgaaggatgtaacccaaataccataactttgaaccaacaagtcatatggtggatcaatagcacctgggctcctaaccagtcaagaagcccaccggccacagcactactgagttgccttttaagccggctgagccctgtggctcatcgaggaaataaatgcttggatttctgatgctgagctaagtggtctgtgtgatttctcagctctgcttctgcaggctatgtctcagagagccgggtttttgctgtgacccaagtaaaatgaaaattgaagctaaattggaaattcaaacgcaacatggaataaatgaatacattcaaatcaatgatactccttccaagtagtcacatgattgcgacgctaataccagtattgggtctactctggggaagcgggtctttcttcagttcggctgaaaagtcacccaagatagcgaggcttatggtcacagtgcacagggccctcaaaaggtcttttctgaggtcacgtcttcctctcaagtctactcacctctccccttccttcactcgctcccctaacaaaataccaccttcttgaggccaagcccagtgctcggcctttctctcttcaacagacccaggactgagatcaaatgaggccgatgggatgccccaagctcacattagcttgttgatgtgttcagctcccagagctgagccctcccataccattttctcagatggtgtgggcccagcacacagggaccagatggggggtctgccacctctgggcggcttagaccccattgccagctcccagagcccagccagccctcctgtctgcccttggctgtgcctcccacctgccaagcaggtgcctgcagcctaaggtctgggctgatcccatccagcagccactcctgacccacagaggcagagcttactgacagctcctgacagcccccaccaggagaggcagggacaggcagagggggactgggcaggtaaagaatgggctcattgctgagcagcaggggagtgggggtggaggccacctccacacagcctccaactctccagcgaggtgcagcgagcagaacagctgccattagctgtgatgagatgtgagcagtgccaggcccacacaccatagcaggaaaacgccccaccgtacagctctggctggcatcttgcctttttcctacttggaaaagacatcttcatagacaccttcatcaaaaagcacatgcgacagacacctggcaattcaccctttgctctccgctcctggccccacctcatcatgactgctccagcctcaccccctgccacattcagacacactgcctggataatcctccccaggctccacagccatcatttccctctcctgctcaagaacctgcagtggctccctttttcccagtgcaaagctgcactcttctgccaggtggccctggccctgcctacctaacacccctacttttggccgcacccagcttcctcctggcccaagggctgcactcacagggcctcactcattcctgagggttagggctagggttaggttacggattctgtacccttattcaagtagctctcgatgccttgcctctgtcctccaggccacaattttccaaaaaggagttttcgttgcacccaagttattcatagctatgtgaaataaaaaggtagctttcaaaacattccttctctttgcttaagctaacttgattttctgtcaacttccaaccaaaacaatcctggctaatacattatctgaggatgaaaaagcaattctttcacttttctggtatttcttacagagccagacaaacacgaggtgctcaataaatgctaatagtttgctgtgcacatgtgtgtccatctcttgatcatgtcccgtgggaagagaggtgtcatccctatagaccatgcccttcagtggcagcaggcacaggtccctcacactgtcccctgatggatagagtcctgcctcaactacaccccccacggctctggacaccagccctggagcattcaggtccaggtctcaacaccatcccaaatgcaggaacccagacatgtggctctgggtccacagatgccactcttcatgtccgggagcaaggcttgctctgtgggggtgacgcggtggggctgcatcttcccgggaaccccataccacctcagccaccatgccattctcagggctggacataccccctcatttgctcatcggctgcattcagctatagctttctggtggcacagcacatgaacagaagtgcagcctcggagtcagattgcacaggttcaaatctcccaccaccatccactagcagtgggatcctggaaccccacctccccgggccaatgttccccaccatgtaaaatgagaatgattgtagtgcctacatcataactgttgggagatgaacaggcttaatagcttgagttattaatatcactgtcatggttattattgaccctgaggcaggcactgtgcaaggtggtgggtgtggggggtgtgagtgtaacagagaccagtgagacactgtcacacccagcttgcttaggaggagtctgggaggcctggccaagggacatactttgtgtgaaaacacagtcgcccagaaatcctaaaaaaaaaacaaaaccaagtcctttgggaccccagagtggggaagcagagctccaggggaaatgccatggacgtctgggctggcaggagttggaggcccagcagctcagccccgcctgtgccagagctgtctgtcctgcctctgtcatgccacagaacagcctcagtgacccagggcccaggatgcaggagccgctctaagagggcaggcagaagggcagagaggaccagtgagaggggccaatgttctggtgccactgaagggcttggtctagaggggtgatacctcccttcctactggacatgaccaagaggcagacacacacatgcacagcctctagaatgctggcctcagctggggaatctagctcatagttcactgctccagaacccatttcaaggtcctgcatactaaggaatttccagtaagtacctccagtcacagcaaagactgtggccctgaatcccatccacaatgtttttgttttgttttgttttgtttcgttctgtttttaagacaggctagagtgcagtggagcaatcacagatcactgcagtctccatctctcaggctcaggcgatcctcacacctcagagccctgagcagctgggaccacaggcacaggccaccatgccccactcatttttttttttctttttttggtagagatggggcctcactatgttacccaggctggcctcaaacttctggcctcaagcaatcctttcacctcggcctccccatgtgcttggattccaggcatgagccaatgcgcctggcccacaatgttaaactcagattttgggggaaaaagcaaatccaaagccgattactctgctttcacctcatgctttaatcacaccctgaatgcacaagggcaggaccttagtgacaatttagaattccaaaagccagggtttagtgaagcctgttgaatcccacttccaaaacagactgtgtctccaatccatgcctccacaccctcaggtggggacctgcacccagccctatcctggcctccatgtggatggctcccttctcctcatccagagctgagaaaagtaggaatccaagacaccatggagagggctgtgcatgtgctggtggaaacaagctccagcatgaaaatgggggtcccagtggccctctgtctagttgacaacagaaaacacctccccaacttcccatggctgagcccctcctgccaagagcaggatgtcctcagaacccggctgaagaactcagctccacaggcacactccctgctcacctgcccctcatgtctgccccatcagggactcccgctctctgcacccagaacctatgcttccctcccctagaacaggtagggaggaaggatggaccaccatctctctcacactgcttaggcatttcccagcacctaacaacctggcacacagtggcactcagccaatgattgctcaatggcagggggctttctagagacaaacaacatttagtctctgtccacagccctgtggaccagagacaaacgtcttctctaaaaaggcagactaacaatcactcagactaacaatctcccacttcacccacaattaagtggaaatacacaaaaccaggtagtaaacacaatgctattttggttaagaaagaaaagtgagggaaagaagggaatgactatatttgtgtgtgcttgtgtgcgctgagaaacttgctggaaggacacacattaaggtgttagagggtcatctctggaaggcaggatatgtttttcttatttttgcttggctggattttctggttttcctgcaatgaacatgtatagcctttgtaatttatatggtttggctctgtgtccccacctaaatctcaccttgaattttaataacacccacctgtcaagggcgggaccaggtggagataattgaatcatgggggcagttccccccatgctgttctcatgacagtgatttctcacgagatctgatggttttataaggggcttccccctatgcttggctctcattcttctctttcctgctgccatgtgaagaaggacatgtttgcttccccttctatcatgactgtaagtttcctgaggcctccccagccctgcggaactgcaagtcaattaaacctctttccttataaagtatccagtgtcaggcagttctctacagcagcatgagagcgaagtaatacactacaataaaagctttttaaaaattttaatccactgactagtgatggagacaatgttggtaatgactaggcctaggtctctctatctataactggaaatggttggaccagagagctccacagcccctctcagcccctgccttgcagatcttcagaccagagattcccagtggcagtgactcttcactcaacagctcttgctgggctgaggcctcagcagatctgctttctggtccctgctgggtctctgccttcatgggggcaaattgctccctctggccttgactctattccatcacctgtcaagtggaatggacaggccaattttcaagcccgggctctgccactgagtgtcccggtggcctcatcagtaaaatggggatataattgtgcttgatgcataggattgagtgatcctatgcatttgtagagcttggagtgaatgcacctgctgggctggtccctatggatggccctgaaaagatgtgagtcatcatccactctcgtacctcacacagtgttctgtcccatgtgagctggaatgtgcctgctgtgacacatggccagaaggccagaggccaggaggtgtgaggagctgggaggcgagtcagggacagatgccagggaggcctgggaccccccatgaggaggctgccacgtgatggctcccatagccagttcagacactctcaacaaccactttgtctggctgggtgcaggctgggccccagcccaccctggggaggaggcagctccacaggctcacccggccagatgccgcctgcccagatctgcgtcctccatgagattgaagatgacaggctctgggggtggggaggagccaggtcagcggaaacttggcaacgagaaaggcaagaggagcagctgagctcagagcaccccgtggcccccacccttccaagggtgcagcgagaggttctgtctgcaacccctcaagtcccctagtggagtggaaatgttcttcatctgaggctggggtctgttaccccttcccagcctaccagcttccaaagagacagcagaaagtgatccaaagatccaatatttgtattttgaatgctaatttgacatagaggagtgggcatggggagtgtttataatcagcactccaataagcccacaaatgacgccagtattttataagcttgttagaaacaaatcaccccctcagctgatatttacttactgatgaatcataaaagggctcaacacacaaagaaaatccaaaaagaatgtctttcttcatcccatgttcggcaacaatgctgggagcctggcctgggtaagcccaagcagcgggccttctccagcaccagtcctcagccccccaatccccacagcctccccaggggtggcaaatcatcggtgccagccccatctccgtgcccactccccaccacagcccccacccatcgactggcctaatctgaggctcaattcagcgctccagaggcagctccgtccttctgctgcccccggagtcctctgcgggagcggatccaatccagctaatttgcataatgatgaagccctccagtgcgggctgggtcttaagagggttgggaagaaatatgccctgtcctttggagaggcacacagaaggctcagtgcagcccgggaggaatggggcgcctggcgggtgggcgggggcagcgtggaacccatcagcttccccgccaaggacagctcagccctgtcgcccgctgagcctatgtccagctggcccaactgaggaaggactgcccagggctgtaaaccagtgggaactcaggcacagagcgccagctccagacgcaagccggagtcatatgaccccggtcacagcgaccgccactcacgggctggctgaccttgggcaagtcgctgacctctctgaatctcagtctgctgatctgtaaaaacagagggagatctaccctacagggctctgtgaggaccagcagaggtgcctataaagcactgagtagagtgggctgatagaatgcaacaactgtcagctgttaaattaacaccgtcattagtctaatccctgtggtactgggtccatccatgcacacatccacctgtccatctacccatccatccatccacctatctgtttattcaacaaatgccaggtattgtgctaagcagtctggagaagagagaatgaattagacacacctgcctttaaatcacctctagcaacaaaacgacagtatggtccagaggtgaggccagtgcttgcctttgagggaggcaatagcaggaaggagtgcagggagctaccagaggccactgggttcgacttctcgatctggatgtgttctatttctgcaaactcatcaagctgtgcacttaagaggtgtgcatctctctgaacgtacgctatacttcaacaaagttttaaaaaaccctcacgtctaattagggagggagatcagctgggtatgcacataagcattacaccaggcaggaaggggtcagctccttaagaagggtgaataaaatatttgggatgggggtcgaggtaacaccaagggggaagaaacttcctccgtgacaggtgaggatcaccttagcacatgtctggtgcataggtacctactgaatggatgagtgaatgaataacttcctgaatgaggtggccttggatgaacaggctgagatgtggaggcagagagggcgttccaggggagggtgcttgcaggggctgaaggcttgggagggttttcctcactgagccaggtgctggcatgcagcagtgacctgggagccagggcttttgcccttgctgggctcacagtctacaggcatcagacatcaagacgtaactccaggggatcgcatccttcttctattctgcagaaactgagcgcccaagcgcagggtgcagcattgggtgctggtgatgtgcagcagaacaggacaacaggacctctgacctcacagtgtgaccagaggatcagagctgaagcgaagccagctttacacagtcacttgctcatcacagtggcactatggggccggtgccgttattattcccactccacacatggagaaagtgacactgggtgaggtaaagtgattgtcccacgtggctgatccaggaccgaaatgcaactcttaacctctgccaacaatggcccttccccttggcctctacggaacactttatccccaggtctgtttctcagccatgtgagtaagctggatggaggtggcatttttcgtcccattctgcaagttggaacactaagcttctaagtatcaagttgaaaagatagtaagtgacagaggaagtgaatctcagggccctgactccttgtccagtgctccttcccctgcccattgctgttggacaggataatggggactgtcatgaagaggaggcgccgggcaggcttgacaagggcagccccatcacatctcaacatgtgcaagactgggccttggctgccacatgaccatgccaccccatcaaccctgctcagagcctgtgagctacacaggtgtcatgcccagccctgccagccagggtgaccccccactctaactgttcagcaccgagcctccgacagaaaagcaaccccagactgcagtggtagctcatgctgaaacaattctcccaagctgctttaaatggagattttgcagtttggggtacaaaattattgtccacgtcacatggggagtgggcagaatgtatttgcctgtgctgagccacagttctgtctcccaagcaaagctgaacagacactagccaagactgggctcgctgagttaataaagattagctctcctggactatcttggaggcattcaagtgctaactacctgccaggcattcagctaaacactttacatctgggatgggctcataaaatctctacgaggaggtcatgatcttgtcctcactttacagtaagtgacagcgcccaggcctttcaaccacagagctgtgctcttaaccccagggctgtgctaacttccttaccattattcataatcgccattggtagcataaggatagaggcaattaaattcaacacttaatttctgttatgtgcaaagcatagagccaggtgttgggaacataagcagaatgagaactgacctctgtctgcaagaagtttcagatttttatacccacaaatgcaagacatcttttcactaaggttttttttaatgatcaagcacattgcccagcatcttgcacaataaatgtcttctgactacacaaacaaacaaaagttaacattttttaaggagaacacattttccttccctactggctgttctcaattccatttcaacacccctccatccacttaaactgtgactttcttcacttccaaacagtacaaacgctttcattaagaaactactcggtggggtgtccttgggtaagttggtgccttttctgagctcagagacctcatttgtgaaaggaggaggtaggatttgataactcacaaggtcactcggggatagagtactaggatgttaatggccagtccccatcctaactgtagaggactttatcagatagttggcggctataaagggatgagcatgtgagacttccattacaaagttcaagatttaaactcgagggcaagacatcagaaggaggcactcatagtgagcgcgcacagcagctgaagctatccgtggaagctcgagatgtcatcagggggcacagaattaaacgccaaggctgaaccttaatgcttttcgaatattccctgcacttcttatcagtccctattgtcctgtgctcctcagccccaccctgatctgcttgacctcaaaggtcattgagtttgtgacccctgtgaaagagaattcattcttcaaaggcaaagcaagagagaagaaagagcataacatttgttaactgggggacgtcaatgcctggtgcctggaagctgtgtgatcttaggatagtcacctaactcctctgagcctcagttttctcactgtccagaatggacaaaagttttatctacttgatactctttccagaaaaaaaaaaaaaaacaatcagccagctttcccacacttccaataccctgcagaaagttgtaaactttagagaaatcaacaaagacctgtgtattaagatagggaaagctatgttgtagtaacaactcccaaaatctcaaggggtgcaatggtttatttctcatttgcccttcacatccattgcaggggtttctgcttgtgaaaaacactcagatgctgagagtgccccagggaaagagagaatgctgaaaggtcccactctgttggttaaaggctccactcacggctctctggccagaattagccacaaggcttcacccaacacaaaggggccacgatgcgtgatcctcccacataccaaaagacgacactaaggataccacgttaacaagaagagccataaggctcagcagagcactctaagaatctcaagggaggagtcagggacataagaaaaaagatgaaacctgaaaactcaggatggtaacaaaggttctcagaggatgtttgcattcatcaaggcccaggaatggtgggggtgagcagctggcagcatgctctccaactccctgggtcagctccacagtggtgagtgggccctggcggggaacctccaacccccacgccctcttctgaaggcggagggtggcacgctccttccagcactccaccacagccacccagctctccaaagagcacagcaggtaaatgctgggcgttgtcctggggcttctcgcaaaagtcgctcttgacgataatggctttaggaggctatgcaaccacacgcctggcatctgaaacatcatctgaggccaggtgttgcatctctaattaggatggggatttttttcaccccacacagaatttacataattgggaaggaggttacaacgaggaccatccccaccaattgtgcgttttccacggcctccttccactttcccttgcacacctcaaatttaaggcagaaatgaatcgatttgaattttttgaaattaattatcatcattgccatggaaaatgtatctgccactttccctggggagttgagagaggaggggtgatctcatgtggaggagtgctgggagtgccacacatcacccactgtcctcttaaggaaaaacctccacctcacccgacctcacccagtgggtcctccaagcacctcccagtttggtctgagcattcttcagaattttttttagcaccaaaattaatgctttaaaatgtcacttgctacagtaaaatttatcaacattattatataccatagaaactgccatcccagacaaatgcacgacattaaaatttggtctagagctccccagaggaaacgtttgctgcaatttgtataacagtttatatatttatgctatttaatggtacaaagcaataattatgacttcattcactgataagcaacggcattacataaatctgatgcggatttagaacatgccagctctgacaccagtgtactagttgtaaattatgttgccgttaaaaaaaaaaatccaagcaaatatgaaggagcagcaggaaactaataatgcatctccagctgttccagttaacctgcaaatgtggccatctgcacctcgggagaaagagaaggggagagagacggggaaggcggagcagagagaagggagagaaggagacagccgccttcggggaagcacaaagccttcccctgacatcgaaccaatgaccttgctcctcgctgccaggcaagccgtgcctgaaccaggaaaagtttcccaagagcgctgggtccattctccactcctctggcatccacacccggacccacactcctgcccctggccagaaaggtggccccagtgtcatccctcctttccctgcctctctagagactcatcttgaaccttccagttcctagttactgcaacactggtctgaccaggcagcttcctctacaacttcatttctttctttctccttttcattttaacacaggcctatcttgcattttttttcttaagtgggatgagtggtgaaaaaaagtagttattgtcagatgtgtgcccacttcagatggttcaaaatggagctacagggttcaaagactcgaactattgaatgaaatggaaatgctcagatggtggcagatcacagatctgcatgtgaggacttccactgggctttggattcctggggccgtggggctcttggctttgcctggtgaatggggggcaggagagatggtctcggggccaccaaagactgagggtgggaacaggcaggagctgcaggctgggggtctgggctgcaactcaggccatgccccaccctgcctgcaccccccagagcagacaaaggtcccatccggcctccagccagatggcagggaagagctctcaccaggcaagtgcatgattctgcttaggggcatgggctcccctgtgaacctccccacatcagctgcagctccctgggactgtccctgggcccaaagaacggaggcacagcagacccatttcctctcctctcctccagaggttggctgaccgagaaggtgacaggtctgggaccacacctccttccctaggtagaagggtgcatctacagcttcagcaacagcagctaacatggagcatggattgtgtgctaatgtgctgaatactttacataaattcacacatccggtccttgtaacgtccttttgtgctgggaactactgttattcccatcttacagataaggaaactgagtcacagagagattatgtaacttgctcaagatcaacccagccagtgaactaactacatttctgaaccgtaaggcttagaagaatgtttatataagctactctgtacttttcaaatatgttttgttttttccttctttttttttttagacacaggtctcattctgcttcccaggcaggagtgcagtggtgcaatcaccgctcgctgcagcctcgacctcacagactcaagcgatcctcccacctcagcctcccaagtagctgggaccacaggcacacgccaccatgcacagacaatctttttcaatatggacagagtcttgctatgttgtccaagctggtctcgaactcctggccttaagcaatcctcctaccgtggccttccaaagtgctgggattatagggatgagccactgagcccagcctcaaattgtttaaactgcaacccacagaaagaagcatatacatgatgacctagctgcacattaatacacatggaaaccaaagcaagtttcatggaaccacgtgagagcttactcaggaggatggattctgacattacccttcccttttcccttttcgtccattctcttccattctgtgttctgctccgccctactgtttcctctttcatttcgttggctgtggctgcctaagttgatttcatgatttgctaatgggttgcagcctgcaatgtggaaaacactgcctatttcaattccctcattttacagaaggaaaactgaggctcggaaagagaagactgcttggccaaggccacacaagtctgtggcccagccagaaccaaagcccaggcctccagctctctttctacaaaacctgcagtcaacgccaaccctaagcctttcctgggcctactcagtgcccctttctaaccacactggggataactgggtccttggccatagcgtggggacatcatttgtggataagggacagccgtgggagcaagggacagacaagggaatgtaggtctccccaaaggggctctcaactcatgccagtaatgattttggggatgtggccggcccaacaagtctagctctgagggctgcttgccaactgcccccagcctgctgggcagagcccatgtggtcacacacagagaaggcgaggcactgcctgcctgggagtgacctccatcagggtgggcctcccttcgcaggtacctagagggcccctttgtggctgggtttgcaggaagctgctggaccgatgaagagacagaggaggaaacaggtgattctcacagggccacaggcagaatcagcaccatctctccccactctcccttatcatcaggtcccaaacagaagagctatctctatgccccttccaggtgggccccccacggaaggccctcaagctgggacactgggagggatgtgtgttcccaccaccctccttcccactcaaacttcctatcgtgttgacaaaatgtttttgcaactaagaaaacagcatttcttggctattttaattttcacagattcaacctcagttccaacatccaacgctccgcttttctgccaaaaagtttcaaaagcctccattggagatttttgcaaggtgcaaggaattggttcctatcagcatctcaaaacacaattccatcccccctcccaaaatacacacacatcagcttcttcaagagacacattctaagtacccaggatacggtctttttatttttatggtctaagcagaatcaattccaaggactagaaaaacaatccctcagtgagaacctattcagtgacactcccaggaggtcccgaggccaaactagtagctctgtctccttggcagcatgggggcaaaggacaaaccaggcgggaggtgggtcagacctgcacctgctgcaaaacacgcagggtgcatggaagctgggatccagagaggaggattgcttagaaaaggcctcctttcctcccaggaagggtgaggagaccctcgggggcacagctgagccagagtgggtgggggctggaagacaaggagctggaagggacaccgaaaacgggcccctcaagtctgtggctgggacaagtggaacagccaggaaggcatctgacatggatggaagtcaaggtgtttggacacctggaccaagagagtggcctcccacttgtacactgtgcaagtcctgtaccatcttccaactcaaatctgtggttctgttttagggccacatgggtgtgtgtgcatgcactcatgcgctttgtcattagttgccaacatttaaaatacaagaaatttgtattaaaatatgggcttttggcttctcttgaaaactcagaacatctggactctcccagatgcaattgcctgggcagccatggaaggggtgtgggctctctgcagggtctgcataaccctcactgtcccacgtgcagctgttgcaccaacttatgttaatgcttggcccccatagacacagagttgatgacccttgaactaggagaccagggtaccagctccctctgccactgactcactgtgtgaccttgggcaagctcctgcccctttctgagcctcagtaaaaactgtgcaatgaggagggtagaaatcaactctcttatacttgatgcctccctgatgcaattttaggcccctacaaatagggggtgggccaggagcaattttcctggtgagaagacagggtggaggggggcaaggggccagcgcagcccctgcagctgtccccaaggatgtgctgacgccactactccagcttgatatgaatattgtgtcagagattggagatattaagaatgacaatgcattattactgcagagggaaatctcgggagtcctagagataggatttctaaatcctcagccaaaaatcaatagtaatgcccaagaatttataaaagaagcacgtcagtctgcatttgagatgacacactttcggtttccagctaaaccaaagggacaagtgcaagcgtgtcattcaggaagggcaagaagcaaaaggcaaaaacctcacacagggtcctgcctgggtgatggaaggcagcttgtaggctcttgctcagaggccgggccatgatcccaaaaggcaagcagaggaaccagcggtgctccccaagggcccccacccctccaggaggggatggggatgcagaagagacccgaccccacctggacccgctctaccctggaaaccagcatttatggtgcaagcaagaacaaacaggaggcccagggcagagtcaccagcagggctattctgggctgtaaaatgggtacagaaaaatggccccagctttctcctgggatgctgtaaagatcaaatattaatttaaaaaaaatatcaaacaagctttctggggtgttaagattcaacagagcacagactctgaaggcagaaggagctgggctcaaatctgcatgaagtcactggaaaaatgataataataagtcttaccctacacagggatgttagaagggttagaggtactacctgtgcagtatctggcagaatactgagttctaataattacgacagtttcaatattatggtcatgattaaaaatgtaaacattataatttatatatatatatttcttttcttatattttatttttttgagacaggctcttggtcttgctctgccacataggctggagtgcaataatgcaatcatagctcaccgaagctttgaaatcctgggttcaagagctcttcctgcctcagcctcccaagtaactgggactacaggcatgcaccacccccacgggctatttttttacttttttgtaaaggtgaggtcttgctaggttgcccaggctggtctcaaatgcctaggctcaagcaatcctcttaccttagcctctctaagtgctgggattacaggcatgtgtcgccgagcctggcctatttttatttttttttagatatggggtctcactctgttgcccaggctggagtgcagtggcatgatcaattttatatgtatttcttaataacaaccactcttagtagattagatgataattttaagtctttttatgaaataacgtctttccctggcatagggctcccctgtttataagattctctcataacattttcattagggttgctcagaagatgaagtgaaagattctccattagatggggaactgaagccccccaaaagtgatatgactgaaccaaacaaatttgccaagttagcaacaggaagagcaatgcctccagcccaacacagtcccgccttggaggcagaggggactcccaactgcccctccagtgcccattcctttgctgggcttcatggtccccccacaacaatgatatcttttctctcctgacactggcactgggcagacttagaacaggatgcatccatgctggagagccccagagtcaagcttatccagctcccaactttacagaccccacacctgaggccacagctccaactccacattcaaaccaggagtttgaagcatgcctaaggacttcctcccttccccaatcctagatcctcaggtagtaacgccgggcatagcagcccagggagcaagtgcactaagaatgagcattctacctctacccatttgccatagctcggaggcaagacccacaccaccttcacagcccaccttggtgaccacaccttgacccaggcccccaaatcccaactacctcctaaacaatctggccgaacatcctctccctactttgtccagtctaaaccatttcaacagggtgctctaaatgccaagaatcgactgggcagtgggtggtgagcacccagggtgtctccaggaccagttgttctgaaaatgccaactcaatgttctccatttgttttcagggactcattacattaataggcccctatggtatcactttggctattataaatggtggttcttctgcttgactgtgagctctctgatctccctgaattattttcagttggcttttctgatatggaatcattatatgattattgtaggaaatttgcaaaatacaaaaacagataaagatcgcccttaattctacccctgttagaaacccactgtcaagattttggtctgtttccctctgaagatataaatcttacacgagaccttcaggacaaaagcacctggcacagtgcctggtacacagctggtgctcgacacatgtagcttgaagaaatctgtaagaacaatcaaagaatgagtgaatttggatgtaaagtgctttaaaacagcactttaaaattaagagcttggtcaagatggaaactgggatgtagacaactcaccaaggagtatcattttcttctgtatttcatgggttcatttcataattaaatgttaaaaaaaaattaagagacctcatggacacatattaaacacacctacatcaaaaactaggatttttccccctaaaacaaaaataaaaacaaaatacactggtcattccttaatgatccttaatgcctatgtcagtaggtccctcccactccaaaatcctagcccttgccacaaggaagaagctgggaaggaacctctccagtctatacctggagcaccagtaattcagttcaggctgtgcagggtggcatccagcctacaggcatcactcaataaacagaggcaacatttactgagcccttaccatgccaggcactgtgctaagcactttgtgtgtagtatcttatttaattttgacaatgagcttctgttgtcctctgctattttttcccattttgtagacgaaagggttaacacacgggttaagtagctttcctaggacataatgctagtaagtgttgaaggtaggacattaattcaagaaatctgactgcagaatccttgcttttgatccatacactataatgtctcatggattatgaacagatagatggatagatggtggatgggtagatggacatctggcaggtgaatgtaaccatggacaggtggatggtagatggtagatggaagaatgaatgagtgggcggatggaaggataagtgtatgggtgaataaataaatggatggagggatggtgcatggatggatggacagatgaaatgaagaggttggtgagatggagagatggatgtgtggatggatggattgatgggatgaggaggttgaaaggatggatagatggatgggtggatgtcaggtggataatagtcatgtgtcagtccagatctgcctcctttccttaacccaatgcctcagcactggagcacacacaagaagatgatccacaaggctgctcccatcaaaactacaataacatgagaaccacagacctgcttccctcccattgtacctaggaattatttccactcaacccatcaaagggctgagttttcaagcccacaagatcactggtctcttccgaccttcggagctttccaactgtggacagtagagaatttaaagggcatcaggtaaaggcaagccacatacagaaagaggcagtccatgcagcttgcccaaaatacctgctctcatgctgaagactgactttggttttgttcacttccaaacattccctgtggctctcatcactcttcaagtcagagcagaagtgccccctcttctccaaagccctccctctcaccctaggcagaatcagatgccccttctcagagctcccatacagatttttctatcccagcgtctctcacattgatttgctagctgtcctctcccatgggactattcacgtgagagcggagatttctgccctatcaactcggaggcccccacagcccccagttcagtactttgcacagagaggaactcaataaatatgtgtggaattgattccaacatcccaaactgagacctccacagactctgcagcctccccctacccctcttggccacaagtaaacaagagttcagccactgggctgcggaatttagccacctgcagttacttctttatccacaagagagcacagtgtcttgaagctcagcacaaattcttttgtaaatgcctcgtgtacttatagaacactgtataactcaaaaattataattaaaatgtcttagctcctgtatttatagtaacatttaaactactgtgctttcttgaagtcagtcatttacttgagaacagcacactttacggtgaacagatctttgaaacagtaccacggggatctagcccaggcacatgtaactcaatatatgtcaacagctgtaaaaatattggtgggagaaggcaggaaaaaaactatgagcccagatcaagtgccctgtctctcatatctgactgttttcagctgctccctcctcttccaaataattgggccattttggtgcccgctgtcacacaaggcgggccctctttgaggctggatgatcaaaaaggttataaatgaaaatgatttcgatgttggcggcctagagagtgaccagggcgtgcagggcggcagaggggctgttctaatcttaccaactgcacgccgccatcggagagtattcctagggcgcgagcagctccccagggtgaggccacggtaaattctgcctaatcccttctgcatacaaatgagcgcctggcaggaggagggaggggggcagacgccgcagcccctgcccgctcctcctccccgggttggctgtcttggctgaacaaacaagccagcgacagtggagagggctgcagcctgggtggaatgagaaggaggaactcccggggccaccagggctaggggaattacatgaggggatcctaggagcaggtggccctggggcagtgttctgaccctctgaccccagggggtggtggtggggacacgggtgcttgggtggaaaacgatggcatggctgcaggcccctgatattggcccaggtgagagaatgaaatggcagcagaagcagcctctgggctggggctggaggagctgccaggtgatggggcggtttgggtgggaatctgtccttctgaaggcacagcactgagttcacaaagatgcagaaactcatctcccatgaaggcctcaaggatggtagaaggcctcctcccacccacaggatgagcacgcaggaggcccaggaaaggccaggaggaagagcctccatcctgagcccccttggttccagccctgcaaggaagtgatcaattcaattctggcagccagatctagagaaggagtctgggcctgggcacctggggcccccaaagccagagagggctggctccagaggggctgagcctcaaacagggaaacagcccacagaggggaaaagacgagggtcccaccacagagagagccaacagacagccggactggagctacacagtgtcatcctgcagtgctggaggtttctgaagccagttttgcttgcagaaaaacagaggcaaggactgtttttgagatcaattctgaacctggtggttaactctccagggcaggcgttcataacttggacctgtggatggagcttgtggggccccagaccccagcaatggtgggcagatttcacaggtgcactgcatttgattgtcacaatctctgcacagggctaaggagtgacttaaatgagttaaataaaggatgcacagcacttaaactctgcttggcacacaagcaccccaggagcattagctagtattaagatgtttacttgttgggggcaaggagagaaagttccatggcatgaaaaaggtgagttgccctggcaaagatcctggccccagccctgggtcacttcccaacttgaaagtgatgcaggataagaggagtaggcccagaagtggctgtaggggccctccccagtgtgcaggagaaatcatgtcctttgctaagtaatggacccatcaagaggcccaggtacctgcacagatatgcaaatccacacagctcaaaagctagcatcagcccaattctgctaagggatccacacacacccacacacacgcacacacttgtacatgcacacacatcccacgtccacatcttccatgaaatcagcaggaattgcacattttgaggacccaattaagctcagtgtgtatttgacaacctttcaacctccagaagacatttatttttacaacactctccagctgagaaattactaggtttctgccctttcctgaatagtcttggcattgggaagcaccaaggtgtacctggaagcgagcggggttttgggggggtcccacctggaggggcccagcaatgacatcagaaccactcagtaagggggtctcagaggcagggatgtccgaggtgggggcaagtcctgagctccttaggggccacaggggcttccctcaaccttggacatccctggcccaggcttgccccaggcatggcctgagtcagctgccccttccaccttctcaccatcccctggactcctaaacaccactctgaaaggcagttgtatgtctggggtggggagtactctccatctcatggacagagaaagcgagtcccagagaggtctactgacttatctgtggcttggccacacaaaaggggcaaagccctgggatattgccacttcccgctttgtactttcctactcagtaccaaagggggtcagggaacagggtacagtacgggaaataaaaagaaaaacagaaaagcaaagccttctctgctaatgaggtatggtgggctggagcatcagcatggggccagatggcgagagatttcccctaatctttctaggaggccccagggaacatcctcaccagtctccatccatccctgatgaaattcctccaactctctcctgctgcagaatgagtggttggacccaaacctatctcaacatcactgacttatctctgccccaagaggatgaatcttcccccactgaaaagaccaggacttaatatccttgtcaaggaagaagagttgatgacaacatgttttcctgtgggcggtctgctcctgattcctggctctttggaccttcgccaagctccatcttttgtgcatttgaaccaaggtctactgtctacatcagtatcatcaggacattgctggccaatgtacccagatgctagaatttcatgggtatttcatagcagggtcccatattcactaacattttcaaacaaagatgagtaaactgaaggcacgatcccagtcaagaaagcccacagatgtcctcccaagagaggtgcaaacggtaccactgcttgtagatttacccagcacacatctatgatttcaatgttagtctctctttggtctttggctgtctaaatgtcatggtgactttgccagggcaaaaggtgtgcccagaaaattgccaccctgtcacagtagcctgagagcagggtaccgagtagaacatatgctctgtatggctttgtttgcacctctgattctgctatctcacaagcagcaggttggcgattaacaaaatagcaatagcatcgaagccggtgacaactgccatcatcacggcagtgacgacagctgtcaccaggagccagtgagcctgctccttcccacccccagagtccccaaataggcaggagctctgagcattttagggaaacttggccaatcatttccgtgaatctttactgcctggacagattaaacccaggccccaagtggctctcccagttgacaatttttctttcaaaaaggccgaagttgctgtgagccaagttcttgcagccgaattcctggacacagtttccaacaattccaatcagccagctctgcggttgggctgggatttcaagcttgccacagtatgaagtccagtttgggctatattcccttccctctcgcagcatgatgaaggtttccccgcaaaatcaaaaggcttactgtcaagttttcgattggtctgggcttcgtgctatcgtgtgtggtgtgggaaggaatatgaatgtggtgccggctctaccatggggccttgaggcctcgtccaagccatccagggaccttatgaaagtggaacggaactcttttcatgtatattccaactgctgaaattccccagacacgccacagtgtgcaaactcggtgtaaaaagaacaatggctggataaaaaccgaggcgagtcggccgagtacgctgaagacaagccagtgttgctaatgcaagggaagccaagcctggattctccccctccttcttcacctcttcttttcttcttttcttttttcctttagcacgtggaacttaatgaaaataaagtcaccgtgtttccagggcaggaggctgctctttacttgaataaaatgtacatgcaaattcactaaaggaggctggcacttgggaaaacacagagatgatactcagggctcaaactgatggatagcatttatgtctcctttctttttttcttaaaccatagagataatatgtgtctgtctatatgcacgtacatgtgcacatataaaacagggctgtgctagagccagttcatactgactcctgagagccaactgtgcgtttctcttcccaactccagattcagcgaaatgatattggtagactgaaattggcccacagtgggagtatttacaccacagaaatcggcaaaggctacaaaatcaaaattctgttttttatcggacagtgagttattaaatatttaccaactatattgtaactacatctactttactgggggtatgtgtgtatatagatgtatagaggcatatatagatatatacacatatatattacatatatgcaccagatacacagaatacagatgacatgcacgtacttttaacctttgtatactccccttaatccataacctctctttattcttcgaaagcaatatgaaaaccatggatctaagtgaatctgtatgcttttatcataaaaaagcatgaaaaaccaatctgctcttccaaaatataaaagcaatcactaaattgattcctttttttgccaggcattaactttctcctattactgcaaatttgctgcacttgtattttcttccagccccagaattaaacacacttctaatttctcacttcaggtgcattaagtgcggtatagggcacaaatgaataattttattgataataaattttataatccatgcagcacttgctgaaaaatggatgtgttctggatgcattctttatttctcctaatttgaagacgccaggattgcggtcgccctgctcactgagcctttggtaattgctggctattttctactgctttgagggctgattgacaattcaggcacgtgctctgctttacggggataaattacaataaccagtttatcagattattatttttattaatttaagagactagacaacagtagtgagtggcttctgtctcctgcagacagaatttatcctactagtttaatggtgctgtgagaagctgtagacataatatctcacaaaaggtaacatccctatatagtctccccaaatcacgcaaataaaacatcaataggaagaaaccattatgggagagtggtctgactgcagttgagaagggagaagcagagaaaaacaccaaagaattagctggttctgagcttgcttggaaaggataatggttaggacatcagacaggtctcagtcccagccagctgaactggatccgtgtgagtcttaaacaaattaactctctgaccctttatcatcatctgtaaaatggaggcaaaataacatctgtctcttaggacacaggaggatggatgagatcatgtaggtaaagtgcttggcgcagtgcctggcctgatacacacccgatgggtggcagctgttaactgttcttgggagtctatactgaagaagccaggaaagtatttgtatcaggtgagaaccaacaaaaaagtacagtctggaaactagatccacaaaaagttgtctatgattgattgtaatgggtgagttccccatcatgggaggcattcaaggaaagctgggcatttgtggaagagattcatgaacggattctagaatcagaccagatgatttgaggttctaggattcttgtcaaactattcaagattatggaagaatttgtccaaatagccaacgttcattgggtacttaaatgcccagcatagctgtaagcatttttttttttgagatggagtcttgctctgtcgtcaggctggagtgcagtggcacaacctcggctcactgcaacctccacctcctgggttcaagcgattctcctgcctcagcctcccgagtagttgggactacaggcacgaaacgagccaccaagcccagctaatttttttgcatttttagtagagatggggtttcaccatgtggccaggatggtcttgatctcctgacctcatgatccacccaccttggcctcccaaagtgctggaattacaggcatgagccaccgcgcccacacagccagctgtacgcattttacatgtcactatagtttggatgtttgacctctctaaatctcatgttcaaatctaatccccagtgtggtcgtgttgggagctgggatccagtgggaggtgtttggatcacaggggaaggagcgtgagtgagttcttgttctgttagttcccatagagctgattgttaaaaacagcctggcacctcccccctccctcttgctccctctcttgtcacatgacctctgcacatgctagctctcttccctcttatcctatgagtggaagcagcctgaggccctccccagatgctggtgccatgcttcttctacagcctgtagaactgggagccaaataaacctctttataaatcacccagcctcgggtattccttcacagcaacacacaaggtctaagacaaacgatatctcacttaatcttcacaacaactctctgagagagatgctgtcattatcttgattttatagtcaaggaaagtggggcagcctgtccaaagtcatagagccaggaaggggcagagcccagactcaaaccaaggtggtctgcctcccagagccacgtctttggcctctaggcctgtcggcaccatcccaaccacacccttggaccaggccaatggcatccacctgcacctctccctcaccccctgagacccctccccatggcctgctactgaaacatacacatcccactggtatggccagctcaggaatccaagaaaacatctgtgacctgattgctcatcaggcaagaaaccacgagaattccatgtctgctcaagagcctccaatcatgccaccaatgggcagagcttatttcccaccatctgatgggccaaggtcatgcacagcagctttggaagccaggcctcttcccaacataagactgccacagttgatgtgtgataccagcaggctctttgcctaggtttgtgtttccttgatgaccaactgcacctgatgcttagagccacatctgcagctgatggactgcacagtagcctgcccaatggcctgcccgagtgaggacacagcaaattgttaaatggatagatttgctatagatgtaccacaaacgccactgccactgaattatggccatatattgtactatttataatcgcaatgtagttaagttggatttattccttttttcagcaaagactcacctgacccttaaaacaggaagtattttgcttattgcaaaaataagtacatatcaaaaaaaaaagaatatttccagatctctcttttggcatgctggctaaggatgggggtgtgctagatatgctctcaagtagcatctgtgacaatgggaaggaaccccttctgtggccttgagtcagactcaggggccaggacccaatccctgccaagagcctttctcaacacaagagaagacatcccttaaacatatgaaatcaaaacagcccccatgttgtagccaggggaaagcgaaggacagctggcagcaggtggctctacagagaaatttcccaggacaaaagtagatctgtgcagctccccagatccaagaatcaccctaccatttcagccaggggggcctgagcatggtgtggtggcactgagctcctggagcctttggaagtagtgtggaaacacccagatgtccttattcacccaactcccaagacagatgcctggagcaaggcacaaggagggggtgctgtgcccagcccttggtcccccgccagcaacagcctgtttgttccctggccccagaaatcacagctctgtacaaagttcctggtctgggcaggacacctccaccaatctcctcctcgtcctcatcttctaaattcccggcattccacgggtccctctccccactctcctgattaacagccggccacctcatttagaaagctaacttttctcagagttccatcctgttcttgaggtttcggttggaaacttggcctagatgacagctgtgtgggcctctccccagctcgacccagcaggagttctaatacacttcattctggggctggttgctgcttttaatctatcagcacggcgccgcagctgctgtaagctagctgaaaattgtctgcatacgggcgaaccatttgtaacccttttcagtgcaaacccacacttcggcagaaatgcactgtccagctctcccacacctacgaaacacgtgggcccagagtggccaagatcttcccttaaaccaagaggttccccacccgaacaaccaggaaactttcaaaaagcctgaatacattattggcttggaaatttcactctcctgacccaacttctcatcccaaggaaagccaaaaggcttcttcaaaagctcaagcctgagcgccagagcaccatcggcccctctcactagggctctgcccaggactcctctgccacttccctttgattctcagtaagagaaaggggcttttctcccctaaggaagcaggctcagctttgtggaagccctcccacgtgctgcccaccctcagaaccaacgaggacctggctcaaggcaacaccacctgattctcaaatctgctggtgccatcaactcaaagggtctctagtcgatctactcagcaacatcagacccatcggggctccgtgaacaggggagggcaggagttgaaatgcttgccaaatattaatagttacagttcttacacaacagccagtacccttcaggcatccaacacaattttagatgtcaatagggaaagagagaaaggaagaaaagtaggaaaataaaatggaaaagataaggatggaaggagagaatggagaggagagggggagggttaagaaagggagaggaagggaggggagagaaagggaggggaggggtgataggaacaaggtgggtgctcccatcagaaagcaccatctatccatccatcaatctatccttccttccttccttccatccatccttaacctgtctttgcaaaccccctggtggtcagtggtaggaggcctggtctaaccccacttccagtggagacattcagaggagaagttgactccttacccccagacttccatcaccagcggaggagacaggcttcctggcttctccacctgctacagaggcccccaaacagcactcatagccacctctgctgcccagtggggagagaggcctggagagggtccttcctcttctaccactcaaagaaggcccatggctcctcccaacctggctcactggtcattagatttctctgcttacagagcagcacccataaaagtctgggtcacccaactggggcaggactcacaccctgctcctggagcagatgggtgcagcctgcctagactctcaccccacctgcagcccagccccagcactggctgggagaggaggggctatgaaagactccatggcccaaagaaaagaagggctgcaggaggcctctggggagggatgtggagctgtgtggtgggggaggccacctcccaaaatgagtccaactaaaaaatccagtcttccctcagaattgatacggcagcagctgtatctctttcatttgagtaattatcatataattaagtgcatgaattacaagagagccaaggcattaaattaaaatatttaatgcttgtaaatctgaaaatgattactgtgctgatgcgcagccagtgagaagggagactaatggcttggcgggcagcgcggggaggtggtggcagcctcgagcttcaccccagaagttagagaaggggaggggaagagggtgtcagggaattttggggagggggtcagcagcaaccttgagacagggtagcctgagcagaaaactcacagctgattctctgagtagggagagccatttgtcctaaaatgagagccatgtgttcctaagctgccagcaacaatagcacagaagaggggtaagacggggtcctctcactgggactctcattgggacagaaaggaatgggcccaaattgatgacatcactcgcgaattaagttttacccctcacaaagtgttcatgttcctgtgtggacaaataaggaattcaaggcacagaaaggaacagagacttgccaaagatcacaaggcaagttgcaagcagggctgaggctaggactagggactctgacaaactgaacctccccacctgtgaagctgtgatgagctagctcacccagctttagctggctttgatgtgacccaggatggcattagctgatcctttcatttcccaagccaacctctctccctctcaggacaaaagggagatacaaagctgccactgcgatgctcccatgatgctgacgcacagctccacaatgtggaaacaggggtgagctttgggtttctgtccagaaaacactatgcgctgcccagatagaatcaggctagacagaccccagaagggttcaaaagaaaaaggtctcccagtcagacccagccctgccatctcggtcgccgttcatgctggccaaccaggaatcggacaacaagcggccttaacaaaagctcccattcccaccctgaaatgcactcaccagggaaaagggaaggcattgaaaagagcccagccccagtagggaggatgcaaatagccgtccagtgcaggtgcaaggaaattaggtgcatgagatgtcaagagaggctagggcctcctctgcccatgtggcctccaccaggtgtggccattccttggcccagaagaccctcccttcccatggacccagccctctctgatggccagctcctgacattccacttgacagggtggacccagctctaagtactcattccactcattcctggaggggagagccggcctatactcctccggaagtggaccttgtttttattcccgccagcatccattctccctccttttgggaacaatgacccaagagtcttttggggaaccaccatcagagaataatggcactcctgaatcataggtgagcatgtgattcaggcctggccaattagtgtattccatgtctctggataaagagactgggtcagggatgagcatgtgactaaggcctggccaatgagtgtatgccatgcctctggataaagtgattggttaaaagatgaacatgtgaccaggcctggccaatcagagccaattgtaagaattttctggtattatggaggttaaaggactctcctgtcatggaacaccatggaactgccagctaagggggtaggatgtgggcctggaggggctggtggccattttccgtaccatactgcaagggttttggcagagagggaggctaatagagaaaaggaggaccaacagctggagacacagagggcagggctgggcctgttgcaccttaagaagccctagtttcagcagcagtgagcccttccccttgttccctagaccagctggaggcagggttccagctcttgcaactcaaaaaacctctgacaaggcatacaaggtatgtatgcctcctaaatcttcagtgcctcccatggagggcttttgtccctttttgtccctctgtctgtctcccttcctgcctccgcctgctctcctgccccacagtattagtacatcgatggtctgaacaaatgaatgaatgaatgacaaatgctgtctgcgcaagcctttgggtccagtgagggctccccaatctctcccacacccattcctattcactaaaattcacagcccacccaaatctgtggaatagctggtgttggatgtcactctgcttgagccactgttggctgcaggcctcttgtcccagcacacacggggagctccttgaatgcaggaaccttctcacatcctcctcgtctgctccccaaagctggtcccagggccttcccaccgccagacctttaactcttcatgtctctactgtgtgaaatgactccatccctccttcaggagtcagattagaccccaccagccccttctagtaaggtttcccagaacaacatccctccgaggaaaacccccgcctctaaagaactctagcacctactgcgcatgccactggtgaccaatcctgttttctccacaatctaccctctcctttccacctctgctaccagcatccttcttcaggccgctatcttttccctcctggatgacaaaatccttctaaccagtttccccccttccagggaggatgagcctgtcctatcacctcactcaacccagaatgagcttttcatggactcctggagaaggcaattcctaagggtcagaatgccccatgggggtcaacatacgaatcctccaagacttctggataatccactgagactgcagatatgaaagtctgcacagagcagatgcccagttagggtcagggttgggaggtgtgttttcctgagtggcagcatggcagagtgaaaagagagccgttttggggtcccataggcttgggtacaaatcctagccctgtaacgtcctggctgcctatatggcctcagctagattactttaagagcctcagtttcctcctctggatgatgaaagtaacagcaggcttgttgcaacagccatggagaatggatgttaagcacctcctctgggccttccactgtcacatggtaggcacttgataaatgggcactgctattagtctggggctggttgtgtggtgtatccctagcctaagtagtggagtgcccgtggaaaaaaagactggcagcttaaacgggccattctttaaataaatgaataacaaaattgacatgtattgggagttttactatgtgtcaggcactgtaagtgctttccatttgttaaattcatttaatcctcacagcagcctaggaggtcagtaataattagtgatatcccattttacagaggaggaaattgatgtggcaggggcgtaagcaacttgcccagggaattcagagctgctaaaggaggtgctgaactagcacttgaagccatctgaggtctgcattctgaccctcctcacctatggagcctgcctgctctgagctatggactatggctgttaaacaaaatgaaataggagagtccttatccctgctcccagaaactcacaaatgacactggcacactcgtgagatgcatttggtagaaaaaggacttctaatctggctctgactgacggagcataaatcatccagcctcaatgcacccccatgccatcgtgaccctttagtgaaggcctgctttgtgcatggaactgtaacaggcaggctctttctttcattatctcattgaactctcatggcaaccatgtgagatgggtgttaccatccccattttacagataagaaggctgaggctcagagaggttaattgcaccatggccacagagcaccacagagctaaaaattaaagcccataatggttccaataaatcaagctatcttcatttatatggtgagttggggggtatttatttaattctttttcttcctctccctcatttttagctcgtagggagtcaagagaggtgcctcctaatgaagaatgaaacagtttgctataatttgctccaaaacagtatgcttaattaccacaacctcttccccaaccaaaccacttaattgaattcagatagcatgtttgatgttatatataatatttggcaacttggccctctttggggagtgtattgattgaggaggaaaacagatgttctggaagatgtttccagatcatagctggaccagacggctctggagtttaaaagattacagaagtgcaaagagagtcgtgataccaggggccagaggccagggcagcctccatcccatcactcaccagaaggccacccccagcacaagtgtgtcagcagaggtctctagggccccattgccaccctcctccaggtcctgcccgtgtgctggggtagagcaggcaggagggtcaaaggcatggccatgcatggcctcctgagctaacaggaaaagagcaggagggctggatggacagacagatagtatccctggtctggagaaggcctaactggaagagtcattggccaggcttttccaacaaggtgctgagccttcttgatttgcttgggttttttggtttatccaacaagaatttgctaggcatctatagtgtgccgtccatttattcattcaataaatatctactaagcacctaccttgtatctttttttttaatccatttattcattcattcaaaaaacaagcatcaaatgtttactgtgcataaagcctcaggtctgggtggtgcctgcccaccaggagctcccagtccagccagggaggaagatattcaccaactgtacacacgagtcaccacctaactgcagcctgagagatggatgcccaggagggtagacaaaggggcagctgctccgagggcatcaggcctgtgtcttggcaggtctgacacgtggagcgcaagtcccagaagaggaacagcatgcacaaaggcctgtggctggaatgcagagtgaggggcaagtgtcagatggaggggaggggaggatgggggtgtctgaccactctacagagacttgtggcctacactgagggtctctacctaaggacaatgggagcgactgaaggctccagacagggagacacattcagaaggccacttccagttcaccatagagaacagatgagtggttgggagcgtagaatagaccagaagagcagagaggatgcaggttctgactgcaagttcagaagtgaaatgcacagcccctccccactcgaacccataggtcactccaaaacagggacaagggaacaggcagctgccctcctagatgaccaacactgcagagggcaagttgggttttgaatttttactattattcttgctttctttgctccatatttattttgaaattacaaacattaaaggagaaggtaaatattttcattcattcttccatccaaaaaatactgattgagcacctactatgtgccaagcaccgtgtgtactaaggggcaaacaacattcaaggccttttaacccaacagtcagaccccagtagccctttctacaccatcttagacacatgtaactaagtcctgaactgccgggttcagaaacagcacctactatgtgtcaggcactggacagtgacctggagtggagacaacacagacctgcagctgcctgaaatctgctatgagcaggagacttgcaaacaggagccagaaacatgacaattccctcggcagagggaacgtcccatcccagtgggacacaaggacagaccccatgagtaaaaggagggagaggcattggagcaggaccacagagagtgggaaggattttaactggggggagtgaggcacatgaggtgaaggtgttttccgcaggagatggcatgcacaaaagcatgaagccaaagcacatgccaaaaacagtctggaaaccaaatcacccactctggctgcagcacaaattggaaaccaaagggccgtaacattgatacctagactgggccaagcacagagagcataagatagctgagcaaaacagtgggcttctttctacaggcactgaggagcccactggagtctttgagaagtggcatgatcaagtgtggtacttccagattgtgagtaacggcacgagttgggaaaggctgcttgtggggagaccagctgacacgccactaccatagctcaaggaactgtgaggaaggtgtggatggagcaggtggtggtgctacaaaggacgagaacatgaggcctcccacagtgcacactggagagggatgctggcaatgggaggaatggaagagcaggtcctaggcagagctgtggagagactcaactgttgtcataatcctggctcaatagtctcttacagaactcatgtgaccaactcatgtgacctgggttaacttaggtttctactggttgagaatgatatggagtgcatagtacatgtaggctctccataagggagagcgggaaggtttggctaactagtggacaggtagatggatgaatgggtgcggagtgaataagcaaatgggcgagtgaatggtgacttaaatatttggatggatatatgaacatgtggacgatggatgatgggtggatgaatggactgatggaaggtagaagtgggtagaggagtaaatggatacatggatggaccagtggatgcatggatgtgtggatggactgatgtatgtcctgcagtaactcccagcagaacatgtctagaggatgctgggagactccaggccagtgaatatattctgggtttataaaccatggggtatctccttggcttacctaatcacttccaattgaaacctcttctctcccagctccattgtcttactccattttctgttgctataacagaatgccacagacaagtaatttatcaagaaaataagtttatttagctcatgattctggaggctgcaaagtccaagagcacagagacgacatctggagagagcctccttgctatgttgtaatgtggcacagggcatcacatggcaagaggacaagtgtgtgcctgtctactcaggtctctcctcttctggtaaagccaccagttccatcatctgggcctaccctgatgacattatctaatcctaattacctcccaaaggccccacctccaaatgactcaacatacggattttgggattaaatctccaacacatgaaatttgggggacacattcaaaccattgcatccatcctctgcattcagaaagatagtccaacagaaagatctggaatcaagagacccagctgattaccaattccagttttgctctgatgtgctgaatgaccttagacaagccccttcccctctctgggcttctctttgctatccagttcaatgaaggaataggactagatcagggatgcgtacatgtggtgagcctgctgatcatccccacgccttcatccatacctcacagcaagccgtaccaatctctaaggaatcactgcacggctgagccccatttgccaggtgatctttaaggaaagtggttctcaaactttagtgaatcagaatcagctggagagtcttttaaaacaaagattacaggctgggtgcaatggttcacacctgtaatcccagctctttgggaggctgaggcgggaggactgcttgaggtcaggagttcaagaccagcctgggccacatagtgggacccgctgtctacacaaaattttaaaaattagccatgcatggtggtacatgcctgtggtcccagctaatcaggaagctgaggcacgaggatcacttgagccaggagtttgaggctgcagtgagctatgatagcaccacagcactccagtgacagagcaagatcctgtctctaaaaagacaaaacactgattgccagtcctcacccagagtttctgattcagcagttgtatgtggggctgggaatttgcatttctagcaagctctcaggtgatgctgctgctgatgctgatgctgctggtccttggactctacttggagaaccactgatctagtgacccctgctctgagagtcttggtgaaacctagtaggtatccccatgtgggggacagcttgccatacctaagactggaagcctgctggagccactgttgcctcctgtcattcaaaggcatccttgaacccaatgacaggggcactctccgcctacagccagctgcactccaggtcgtgcatcccacctcgccctgccctgctccctcctgctttccctctctcctggagcctgggagagcaccaggccttctgctgcctgtgtgctgcctgcccctgctgccctcagaacagctgtgggcttaattatcaaaataacattttaatagtctcataactgaactcccttcaaaacatgccagcggaggaggtgggaaggattctttttagcacctcttcccacccgacttgctaatcggaggcatttaaactgctagaaggcccagatgcccggccctgcccatggagcccctcctgccaccaccaaggatgcagcttccacaggcggatcgaggggtcgggcccataccagactgccagccggaaccaggagtcattgcaggagccacactgcaccttcgtaatgagaagaaagtggctcattcacgcgaacccaggcatcactcaggaaagtggatatgctaagagaacttaggcaattcatttgcgatcaccaggggtttcacttgctttcaacacattttttttagatttaaaaaaaactgctatcaccagcattaactctggctccccgtctccctgccatttcatgtaataattccacggggagtcctggcgggtatttagctcctaatttaagctccactaaacaagcccaacgcaaaactagcttctcagatcagcagtttcccctcctacttgccgcagccccttcactctctaggttcttcaggcctctaacatcacatccggccagcattcacaacacccgggctgtgagctaagtgcagagcatgtgttaggagtggctgccccagtcctcgttcagcagcacagggagataggcccgactgtgcctaggaggaaatgaaaccaggacaggccacatccccaagctgtatggctagcagtgggtggggcttcgacagaggccaggctggagggcaccgtgctacctccggcagcatttgccctgggtgtcccgacttccaagccagcccttctcaaacttgactgagcatgcaaatcacctggagctcttttaaaaacacggattcttgtttggcaggaccaggtgaggcctggcctttggtacttctcgcacactctgagacactgcagatggtgtaggtcactggcccacacttggaggagcctgaaggaggcacgggctgccctccagggtggttagatcagagactgagtgcaggctgggagaagcaaaggccaaactctgtcttagggtggggtcctttttctcccctggctctctcctgatcaccccagatagtgctcctgactcctgggagagacagaggggcagggctatttcaaaggtcagtgttctcatcttaccctgttcatcccgtttctcaaactccatacccagacatggaaccagaagtttcctttgctctctggaggaaattgccagaaccagacaaatccctttggccctcatcatatttcctgctgcccgcattgaccacttactgtataccaagatagacactgggaacactgggaacagcaaccgtggctgtggtccctgtgctcaggcagctgactggggtgcctggccagctgctgtccaagggagctcatggtgccaggtgaactcgtggtgggggcaggggcagaggcaggggtgcaggcaagagcagtagctgggctgggcactgccaggtgccctgaaccttgacagagtcaagtctattgagtgttagccccaatgcaactacattcactaccaataaaaacggaggccaccatgccactcgtggacactacctggaggcaggcactctttcacagacttgtagactcaggccactgcagtccgtagctcaaggccaacccttagcaaattggcccctacccatcagaaaactggtcctgttggaaaacccccagagcccaactctctgctgcccacacagtctgccccagtagagttcagagccctgaattcaagtcctacctttgactttccagttgctgtgaccttgggcaaattagttttcttctctgagctgaattttttccattggcactgggtgtgattcccagggtctagcccagagcagatactgtatgataaggaatagatgcgcatatattctttattatatgtagtctttgaagtgaaaggcctttacctttttaaaaatgtagtttaatactattcaatgaagcaagtgattactaaacatttaccaaatccagaatttgggggccagaaacagagggcacagatgagaagacaggcaagtccctgttctcaaaagaatctggaaataactgagatgtgccaaatggatgtgacaacattaaagacaacccgggcagacaatgaggcagtaaggttgggtgtccaaccacccagggcagacaatggaagacctggggtcaggccagctggcgtgggggggtggggtccctgcaggagcggtgctgtgagccaagtctccaagaatgggaaagagttgtaggaaaagaaatcaaccaccacagccataataatgtcaaacatttatgtactcattgctactccatgtcaacactgatctatgcactctacatacttagcttatgtaattctcactagcacataaggagagggtaccgttatcatcaccgttttactgaggagaaagcaggcacagtgaggttacatgacttgcctagttgcccagagagcagagtgcagaactgaggctcacacccagacagacgccagggccccatgtccagcaaggcccagcgaccagccaggagccagcatctccacaaacagagaaaaggagggctgggacatccctccaagcagggtcaaaagagaagggaaatgtggtgcaagacttggaaggtaaggcaggcagtccagcagccgctcaacttgcagcaggtaagtgcaggaggagagcaaggccaggaggtgacttaaggcctgcaggaaaccttgttggcagccacaggcagtgccgaccctcctcactcatggagagaaggatttccccacgccccactgatggcacaagagggagacctccactgtagaagcagcttctgtcctccttccaccatgcaggtgcaagaggcctctccaggacataacagcctctgtagttcctatttgccagcgatagagacccggctcccagccaccctggaccaggctgcctctgaaactctgcactcacattgcagtaaaggccagtgcctgcttgacctagacacatggcaggcacacactgtgggcaggtggaagaaggcggcagggggtgaatgtccagcacctgcatttggaagaaaggcaggatcaacagagcctagagccacagtattccaagatcctcatttctctgggcagggagctgggcatgccattgtccaaggcttttgaagccacacaaatggcaccagtcccagtaaacatcccccaagacaggacgggaatctgaatccttgtctgcaaatggccacctgccagggacccccttcagcaacaagctccctctcccaatcccagaggtggcctctgtccagcctatccatagcagctggaacaaggcatcccagccccctggctccagcgggggaaggactgcttccatttgctaagggtcttcttcatttccttcaccttctcacaactgcactttctaaaacaggatattaagggaagagaaaccgagggctttggggttttttagcctctgctccagggaaaaacagacactcatccctgtctgaaattgcttcactccgagagcttgtgggccgcgggagcctcccgccacagatgagcagaaaacagagtttgtttctctatttcccagccccctcgcctctcgccctctccttctctctcccacctcttcctttctgcctggtgcatggctgggagctgggaccttgtggctccacacggctgcctggtgccacggagcagggcatgggctcccacagtaggcagcctggaagggagggggaccagcagaaaccctgcccacttcctcccacactcccgaaacccctccaaaccagtcatcaaataaccctggacggaggtagacccaaggaccttttgttccctgaaatattcaggttttcaggtcattctctggccttgccaggaatgcagtgtactcctggcttgaacaaaatgcgctagtgttaaaatattcatctggttttggttgggactgagagggtgtgtgtgtttcagggaaacaaaaacattattttccccgcttcctctgctcccaagcatacctgggaggttcatgctccaccttgattttggcaaattcttttttagattcctccatgttccccaggatgcagagggtgggagagacacagatggatggattcaactagttgttgcttctccaagggaaaggggagggatattagatattttcttggaagttaattcaactcgaagctgggcactgggaatattctgtccaagcaattactccctgcccccccacccccacccactgctgccccaccccagcccctggtggtagctgcctaccctccagaaggtcaggtgcacacatgcccactgaccagatctccatggggcaggacccctcttgggccaactggaccacactagggccctcaggatcctttaattatcagtcactccacttcccttccctccgctccttagtcccagcacagaaacctgtcaagcgtccaccctgaggactgggaaaatcagctacctactggccctggtctttaactaaaggcttaagctaaattatattacagaccgtggggagcttgggagtggtggctggaggaagggctgttgttgggcttgtggggagacagaagggagggtccaggcaagctgagcgtgctggcatccacttctcaggaaaagctggggaaactgaggcttgcgtaggagtaacataattcatgaggggctggggaggcagggaatccagccagcccctgctccatcctttctcaaggaccaccataaagggttccaaacagtctttggggaaagaagaagacaccccaggtagtcagtcctgcgagatgacctctcccatgggagggcacagggagggctggcagagggtcagctgaagaaattcagtggcccagagtcatccagaccaacacaccttcctgcctcacatgcagtttaccagtgagtttgtccacctacctttcaaattataccttgacgcagcctccccagccactgccaccaccatggactgtcatctccagccagtacagcagcagcagtggccacccacgggaccctgagcttccacccttgctcttggatgttcccatctccacccagaggccatagcaatctttatacaaacttaaaataggaaaatgtcactcacagcttatagtcctgcaataatttcctattgcagagaataaaatcccagttcttggccacatcctggaaggcccaatatctcctgggctctgctggcctctctcacgtcatgggagccactgtcccggtcactccccacactctagccccacacccagctggctccctctcatcctttaaacctcagcttgaccaacatcctcccaattttccctatccctgcaccaataacacgtctcttagtttgtaattatgtatttacttgtttgcctgtttattcctggctttcccatcaacacagtaaactacacagaggtgtggaaaatacatgtattcattccccagagcccagcaaagcgcctgaagcagagcagtctctcaaatgtttgttgaatgaattaaagaacacaggccttccagttagctcaaagcagaacttccccattgccaagggatgaagaaaggagagctttgaacactcaagacccgtagaaacaaatattcttccaacctgtgatgcatatcaatcttccttgttccttcttaattcctgatcacatttggattcagatatttaagaagccagagaagcaaatgttatacaatgccccgagaaggccccagagattccacattcgagggtagaaaagtttcactttcataaagcctaataaaatcttgcttccaacgagcaggcagcggagaacgcattcagagagcctacagggtgctctgtggatcgtgagagcatagaaacgtggactgtgaccagaataccagagttcacaggacccaccaggaggacagcccgaggcccagccaggcccaccacatgcacagaaaaagggccctgagagttcacgggctgagtagatgtacgctccagccgtgatatttataacaataaatgattcacgagattgccacagcccacctcagtcctccttaagaaccgtggacaaaaacaaacacatactcaccacccgctccccaaaaaataaacaaggggggaagagaggcggtatgttcctccagccccactgatgtgggcttactcattactctaatgtaatcagaagaacattaaacatttctaaagtctcctctcttttccatggctgattaagcaattgggagcggagagtttactgtgaaaaaaagcaaacaattatgtgctatccgaggtaaacattaccttagtaatggaagctgagatgcgcagccccatcgtcagtagggattatcattataatacttaaaataacatttataacacttactgaaattacacgaatgaagtctgcagagacaccgaaatgaaatcagctcaatgtgtttttataagaatactgaaatctctgtcccttggaggaaagttataggcattaacagtttttgctaggcctccattagctggtaaaatttgaatactgtttcttaggtgagctctaatcttctttgaatcctcccaacacattttatctgtaaaaaattgtagttaaaaatttagcttgatggaatgatatttaagtgcttttcctcatctaactccctgaaagtgccccagagagtctccctgtaatttgttcaaacgaaataatattttcgtttccccgtttctctttgttgtcttgggtgatgaaaagtaacatttcttttctttcaatcctattaagcaaggctcgaggaatgccagccactcaatccaaatgcgatctggcagacaggcactcagcttaaaaaacgggacctgccaacccgggtttctgtcaggagctgacatgtcaccaggcgtcagttctgtgcaacatttcccaagcaataaccagggttatcagcaagctgagtgagttttttccttctctctcgctctctttattttggttgccacgctgggaaacttggctcaaatatctggttagttgcacctactctgtctgcacacccatgcaactcaccacgctcacatagtctcctgagcccacctgacgcctacacgcaagctggggatgcaagaaactgtcccattctccaactgcagaacttcctcccaggggaagccccttccaggcaggaaggtgcatgagatcctactctgttcccttcctgaatccattgagtctcctattcctcttctcatcccccatggcttccttccatattgcagacattgatcaaacttacaaactccaagccactcttcaaaacctgttataaaatgtcacctcttctctgaagccctccccagcatccgagttgtatctgtgctcccattgcattctgcaaatgcttttacttcatccagaaaggtgtgattaaataagttacggtgcagccataaaataaaacactatgcatactctattttttaatgaagcagaaccaaatgggttgaaatagaaagaagtccacagtgcaaacctaaaagcgaaggaagcaaggtgcagaataaccaatgtaattgatcccatctgaataatacatggaaatgggcataggaaattcttggaggcacataaacatcaataagagtggtaggtggcttccaggcagtggaaactgagggaggagtcaagaggggttagagaaggaagaatttatattcttctatgtattaaaatgtttttccacaaatatgcattacttttggatgaaaaaacaataaaatcaacctatgttgatgaaaaaaacacttattagcaccattttgaatttctacatttaactcactggaatgaatgctatcacaggataaaccactatcaccaaagatcagttttatcacacaactttctaaatgacccatactccctatccatatgtgaatatcttgctgacatcacaactgttaatttattgtatgtatggaacccctctgaagatgaaattctcttagcgacctactcaaaattgggctctgccttcccctttctgttcctgcctggctggtaaacagaaggaaaggccagccaagaagaaccacgatgagacctcagaggccacctatggaccgcaattttggacactagcaaagggttaggacctaggaaccttcctggactgatgggaacaaatggtcatgtgtttgaggcattttggccaacttgcaatggtgggttttttcatttcctgtatgttcctatccttggatgaaagaatagcaagaacagtatgaccagggatgctggcaggacactgacatttgggttttccagataaagctgccatttgacattagaaaagcatcttgtgatgatgctaatcacaccataagtggggaaaaaaagtcatgatggcagcatcattcccattctataagaaatgtctatggattctaaatgatttgagaacaaatacatgtgcgcaaaaatattaagcctatcaattttattctaatgacataattttctttacagatgcattaaccatctacagaagtactaatgactatgcatatttcatatatattcacacacacatatatatatacacatacataaatacatatatacacacacttatatgtcgtcaagctcaatgaccattacccagggagaaagggtggatactgtaccaaatctatatccaataatggcaagtgcctagcaagtgtgacatagtgctaatgaacaatcaataaaatatattgatcaggtttaggctagtggtcctataaccaagtaccacaaccttgcaaatatcaactatctgtccaaagttgggaatccaaatgttttctgctactttgctaagttataagaaagctaaattcttttaaattatggactggagctaggggcaggaggaagttggagcctggggtgctcaggaatgtgtcagtcacagacccagcttgttcactgagcagataccagccaggcctagaagatgctagaataagctctgataaccacaaagcattgtcttccaagcttaaaaagtcccttttgtaaatattggtttgtaggcaccaacacccatgtgcttagagaaggaagatgcaggaatgcaaacctctcccacacttcccatgaaaatgagagttatagctggttggtgcaagggtgtaagaggcctctgtggagcccatttcaaatgacaaagaagatccctcccacagcccccatcgtgtcccttagtagctaactggatatacgaaagaacgtctatctaatcccttttaggagctgggcctctattgtggaatgaattggagtggctgctatctactgcctacgcttagggcatcctgtactttgtccaaaaactgtgtttttcaagctttaagggggctgctgaactttggttttctgggacttttccaacagcccataccacagcctccccgagcctcctagagctataggaattgtctgtactcatacgctggggctgccataatgaagaaccacatgaagactaggtgacctaagcaacagaaatttatcttctcacagttctggaggctggaagtccaagatcaaggtggcagtgtcaacagagctagcttcctctggggcctccctgcttggcttgtaggtggccaccccctcgctgtgtcctcccatgatctgtcctctgagcacatgcatccctgatgtctctctgtccaattttcctcttcttatgaggacaccagtgagattgtattagggcccaactgagggcctcattttgattaaattacctatgtaacaatatgtaatttattgttcaatattgctacatattgcttcaatatgtagaatgcaccgggaacataattcagcccagaacagtgtcttcttgggtctctgttattccggaaggaaggagcctcagctgtcttgtctgtgtcagatccagagcctcctccccggcactcacttcattagctaagtgcaccaggctcctctaagcactgccatggctttctcaaggcagaagggtcagaagtgctcatgaactttcaggggcaatgaccctgactgtttctccccagccaccctctttctaaattacctttaggctgtggcaacagggacttgaaggtaacttcatccaatctcttcccccaagaccccctcagggtagcaagacctgatggattggaagaccttgcagaaggaaaattatgataataaagagccgtggctgcccccagaacacagatcaggtgtgggtgagaaagcgctcaggaggcaggcactgactcggcctctcagccccctgaggagcagcccacaccttccctcccactcccaaggtcccctcaagtcccacagctaccaatggagggtcagaccccccacccccacacccatagccgctgtacagccagccattgttacacaggcctcgatggggggatgagagtttgggaggtattttttagttgcatgcattttgaaaaatttgttcatgtgtgagatgcatactgcctgtgctacagagagcaggctttgcaatctgaatcggcaaatttgttaactgactgttgagtctaatgttataccactattctgcctctcgttagcaacacaaattaccggcaattagccggctgactgttcaaaggcagttcaatttcatgtataaagagaactatataatgcttaatgtatctatcaaatgtaacagcccaaacaaaattaatgatatgaatacaatgagtgcttataagggataattacaaggtgtccgtcatgagaggcaagccatggagtcagacgcacaattcaggcaaacagtcaccaaagttctcaaggctggcctaggctgttaggagacggaaaaggaattgtgatccagaggaggctcagccctgtcactggacagggtgggaaagcaggccaccgtgacgtctgaaatatacaactgtgatttcaagccctgagtaaaatgagacagtgggctccatttcctcatctgtaaaatgggaacaatagcatctgcctcccagaacgctaacctggcacaacacaaccaaacagcaacgaaagagcactgctaactctcctggcctcacctggaagaaggtggtgatgctgttgatgttcttattattacataagaatttccgaggtgaggcccagcagacctcttcccgcctgcgtcgctgacagagtagcgtggcgtgatacaaacgacacttcgatttaattaccacctttttttttttcctcctgtaactaaacattttcctctgctcagtatccctggaatgactgggccattcccagtgtattacttgcatatctataattaaataattaagaattgttcaagcccttccaaacacaacaaaaggcgatgattatttcaaagccactttaggaagagtcaagcccctatcagctccattttttgctaatagttatgcaaggctgcaccggcagcattccctcttgcatgccagcacaccaataaattaagatattcctggccgcatctgcacgagggaaattagagcattacctggtccccgccagtgtgccagctccgagcggcaggcgcagcccacgctgggcgaccagctgtctgcgaatgtggcgtgtggatcacagctcagagccaggggatctcttaggaggtctgctctaatatcacaactgcctcgctgcaggactgttcccttcacagcacagtattcaaacacttcttccgcctctttctttccaactccgaaccagggagaaccgggagctgggacctccgagccagtccccggatgccaacatgagcctggctgatttttcttgttcacctcggaatccttaatggtgaggacagcaccaaggcactttgttttctgaaaccccagccccagctgccttggaggaggggcaacctcattcctggtgggtgtaacttcaccaggcacaatgtctcgttggttttgatgagggacaagtagcccctgtgaagacttaacagccaaaatgattccacaacggtttacacaagcacaaactcgctgtcacaaagagagggaaagaccgattttcccagaaatgggtggaggctttcagtttgggaggccaagtcccagggtgtgtaacgtcttgagggtcaatatccagtttcccatgcgttcctttaggtctgaatctctctccctctgcagagctcctgagcccctgacaatgacagacaggccttggaaacggtccctgtgctttagacaaacaaaagcaaaaagaatgaagtgccactgaccctgcatttggcgaatgttcgaggcatccagatgaagcctctttggcaaaataacctgaggtgccacagacctggatcagagctggggcttggcaggtgggaagagtgaggctatgaacatcgggggtccaacaaacatgtgggtaggggttgtggggacaggtggaaggagctgatctaggagctgctgctgagtcagaagcactgagacaaggggctttgacactggtgtgggagagggtgaagacagtttcaggcagctggctgttggggtggaacaggagagagaaggaagttagggctggacaccattgatgagggttttcagacatgcctgaggacaagagtgtctaaggagtagtcaacagggtctaatggcctggaaagactataaaagtcatcaacttctacaatcaggagtcaccggtgactctagcaaaaagaatttcaaagagcatcatgctctttgcaatgcctctaacttttgctgtacttatcacctaagaattatctttcactgtttcttctggtgaactcttattcatcactttagagacccaactcaaatgcctctcctctttcaaacttccactgaccaccccctatcttcacatatctattcccacgcacacataaccaggacaggcaatcacttcctaacccattcatactacttaggaatttgcacatctatgtgtctacctctcccatcagattggatattcctctaggataggagctgtgtttgccttagctcagggtccccagcaaacagcaaaaagcctggcatggagctggcagaaacagaccagatggcatgagaggaaaactattccaagcctagggtggagagtctgagaccctgtgaatcttccctgctgcagtaggctgcctcagtaagttgtactgggggtcaactcctgaaccaacagggccagaaaccagaagaccatgggcatccatgtgtttgtactcagtgcatgagatgaacatcttcctcccagggcacactgggggcgtctgtccagaggggtggcagctggctcccgaccttacatacgctgaggctaagccccatccccaaaggacagagctctcaccaggtcccatgaggcccacaagtgaaaactggattcttctccctttcactccatctgggtatgagctgttgcaaattatgctgcactttcttggcttcatgagcaggttaaattccacccaagctggtctcatcagtacccaaacaggctacatccttctaaaccttttctgactattccatcctctacattctctttcccatcaaaaactcagactctagcatttaatcctaaactgtttataacatgagatgttttacggtagctatgtctgcctcccaaatatgttgaaagcttctagagggcagcaacaaatcctatatcttttaaaatatctacctcaatccaaagccaagcaagaatatttgataggaaaatagtgggaaagtgctgcctgctaccactacgccaccagtggcagacatggccaaacaagcacctatctgctatctcatgatgaatgattcatgcatgcaacttgatcacttctgccagttttatcggacagctgctctccaacagaactggaaggagctgtgaagtgcatgacttcaaggaggccccaagaagctactgctcacagcagcaatgtgcttggatgcagcccctctctgaggtcctccccagcagccctcctctgtcaacaactgaaggggccacagaaaatcaggagaaacaaagacaacagccaccatccccattcttggcatttcccccaagagtcactgaaacccctcttcccactccacattccagtctcagtaggtcaaagtccatcacaaaggggaaaacccagctctctaggatgtgcccttgtccaagctttcccactgcctacccaaccaaaatcagacaaagagataagacaaaaggtaggaactcttgagccatccatctgctgtctttaatattagtttataaacatgatttcttcctcctctgctactcgctctactctgggcgaagaaacgtagctcaagacctgatctgggtatcacttttcaaatgcccaaatccctgtaaaggtttagtgtctagctgtgtgcattttgctcagtattaacatgttcaatggagtactttgatttttttttttatctagacgccagaagctggtgaatatatgcttcatagcttcagataaaccttttgttcttctggggctgatcagctggtggagcagcgagagggagaaggggaggggaattcacaggggctcagcggtttcaaaaagtcaaattacctctgagccatagcaaggctgataatttaaatgaaaaaatatatatacaggctgcagcacacaacatcgtctctgttaggacttttaatgaagccccagttgtgatgacactgaagccgggaacgctacagtgggataattacttggctcccacacagctgagttccatagatgcattattaacggcacattcctcgccataacgagagctgaacagaggtaggctccgcagaccttggcgtccgccattagcggcctggcgcaaacacaaatgagtgttttcacaaaagcatgcaaaggttgtgaaattccaacgagtcttgagtcttgtgctgggaggtggagatgggatggggtaaaggggaagtggcgaatatatatatatatatatatatttggtccatacagacgtgaccagagatgtcacctttccctgcgcaaggtacttggagtaaggcaacctgggaaattatggagtcagaacacattgattttcccgcagcagatccaggcagcagccctgatgaagaattacagaagaaatgcaataacctaattctcctccaacctggccctgctgcgcctgcagccctaagcgtacctggctggggctgcgggcagcacctcctgacccgggcatgctgcacagctggactcccgtttggcactgccgggcagtcccccattcccagccccggctcacacccaagccacagcactcacaccggccacgttttcaagacatgcaggcatcacggctgcttcggggggcaagggtcttctggaaaagagaaagccacagatacgggcattcttgctcccagctcaccccaattaaaagcagggataaagacacacactcattatcacccagggccagggagagcctctgcacatcccatacaggagctccagggcaccagggtgacttagccaaggctggtgggaagccgttcccccagccctgtgcttccccttggtcttctcctcgatttctcttcccctggaagcgtctgtttcaaggtgaccctgtttcatgagttagccccagcgtcccccgcctgctcacagaaccaggggcctcccagtaattaacacccgcacttgatgaggtccagctggcaaactgaagcgatgccagcatcctcacaccacaacctgggctccagccggcccggtgagggcctttcccccaccaccactctggccactctgtctccagagaaggaggggaaagtcacccatttggttaggatgatgttcaatagagagttgtttctaatagtgacactactaaaagctccaacgggaaatttaaactgtggcacttcttataatggaacaccaagcagccactaaaaatgatgatgtagagacatgtgtgctgacacagaaaactgtcactgcctactgttggggggaaatgattacaaaataatatgggcattgtaactccactggaaaccaaaccaagtgtgctaaaatagtacggacagtataagtccactgcaaactaaacacaagtgtgcaaaaataggatgagcattgtaactccactggaaaccaagccaagtgtacaaaaatagtatgggcattatgactccactgggaagcaaacaagtgtgcaaaaacagtatgggtattataagtccaccacaaactaaacataagtgtgcaaaatagtataggcattataaccccactggaaaccaagccaagtgtgcaaaaatagtatgggcattgtaagtctactgaaaactaaacataaatatgcaaaaacagtatggccatttataactccactggaaaccaaaccaagtatgctaaaatagtatgggcattataagtccactgcaactaaacacaagtgtgcaaaaatagggcattataactccactggaagccaagccaagtgtgcaaaaatagtatggacattgtaagtccactgcaaactaaacacaaatgtgtaaaaatagtatgggcattataactgcactggaaaccaaacacaagtgtgcaaaagtctgtgcattataactccactggaaactaaacagtatgggcattaaaactgcattggaaaccaaacacaagtgtgcaaaaacagtacagacattaaaactctgctggaaaccaaacatgagtatgcaaaagagtaggcagtgattccatttctacacaggaaaaaaaaacaggcaccactgtctttgctgttagaagtcagggttgtggtcctctgggggctgggacaggaaggtgcaggaggtgaacttctggggtgtgggtcacactgtgtcatgatgtagtgcttacctgggtttggtctgggaaaattcagcaagctatctgctgcttatgacaagtaagcttttctgtatgtaatgcatcaataaagggttattacattaggttggtgtaaaagtaattgaggtttttgcagttgcttttaatttctatttattgatatgtctacttttctgtataaatatcaaactacaacaaaatgctttttaaaactgtatctatgcatgtgtgaacacacagaattgggaaaggtaaacatcaaattgttaacagcagttttccctgggaggtgagattaagggtgatttctatctctttcttctgtttatcagcattttttttcttgtaaggaaagtgtattatttgagttttttaaaacacagcttttttaaaaacaggaggggcagttcagctgaaattataaggaacacagccaattaggaaaattgataacaaccaccacatcatcatctactcaacaaataaagcataaaatgcagtttgggacctattcgaccccagagtcttcttaatgcaggctcccctaaaacacagtgacagaattcttttgcagaagtcacttgcaggagtgaattctttttccctggcctgggccataagccatgaaccaaaacgtgaataagacagctctgtgtgccagggcatcgctgtaaagcctatcctcgtcacccacaccagccgggagtcagccacgtgcaaccagagaatagttacacaaaagacaaagcaggcaggaaactcaaacccactcagcaaaggtgtgtgatgcccccacctctgccagaaccggcggacctgagggctatcccctcgcctcccctccccacatgctccttgctcattttagatccatttctaacagatcagtcttcactctgcgatgcccagattcacaggctcaacttctcactgccatccataaacagggaagaagatatgttagcaaggtgtggagagacagctttcgtgcggttgtgggtctggagaagggtcagtcatccaggtgcagtcatcagctcaccctccccaaaccaaaatccttcaaatacctgatcaagatggatttggaggaaaggttgtatgggggagtgaagagaagggggacccctggtggtgactgctatccacagcaatccagctctgaccccaaactcatccccaccccaaagagccaaacctctgggctctgcgtggtggctcatgcctgtaatctcagtgctttgggaggatcacaagaagccaagagttcaagaccagcctgggcaacatagcaagatcctgtctctacaaaaaaaatttaaaaattagccaggggtggtggcacgtgcctgtggtcccagctactcaggaggctgaggtggaaggattgctggagcctgggaggtcaaggctgcagtgagctatgatcatgccactgcactccagtctgggtgacagagtaagaccttgtctcaaaaaaaaaaaaatttctctgccattcacagacctcactcttgtcccttagaggtctcacccctgcctctcccgccagaaccctctctgaagtctggcggacagggtttgcagagatctctttctggtgggattgtagcacctcccacaggtcaacttccaaactctaccctgactctctgcctgcaaccaagccatatgccctccgtgcctttgtttctccatctgtatacatgaaacacccaagccccaagcctgctcacagagaagggagaatggccttagatctccgagaagcccccaagaccagcaccgctggtgtgggacctggaagaaatccacttcctttgcaaagtgagtaaagcttatttaggaaagcacaaggttggggagagggggccgcggaggcaacacactactgaagagaagaccaagaactctgccaggggctcagaaggcagcagaaatctctatctgtaagaggctcctcctggccccccatggaacccgcaggttccccagaggcagcttcctgtcccctgcaggagaacaggaggaaatgttgtcctagattactggggatggaccaagtcaggatagaactcaaaaactagcagtgcaaagcgagtccttgagaaccatcccctcccctcagccccccagctgcctgcctttcagctggggggtaaacagaagtggggacatatctggattaagaacccagagcagtaaatgttcccttccagattgtgcagggtgttagaccctggttcagttgtctctctctttattaaaaattccacacttccctcccatgcgccatcccctctggcccctctggaatctcttccctgcctcctctctcctctccttccatcagaaagtttggtggaaagagatggccacacccttgcggtaacacagccagctgcctccaagctgggaagcccccaggcctctctcaacagagggaatgcttacctctctcacacagacacacacacacaagtgcatactgacacaaacagaaaaacacaggcatacagaagaggggttcactgtcacacccaacatacacacaacacacagacaggaatatagagacatacactccaagatagacacaaaaacacagataaacccacagatccaaatacaaagcattaaacacataagaccacaaacacactcaaagacaaacacaaagcacagaaagaagcatccaatgtgttagcccaaaaaaacacccacaggcacaaagacatctaaacccataaacagaagactcgaaacaaactcacggggatgcagatggacaggcgcaaatataacacaaattagagcacacacggccaacagcagcaagaacaacatgatacacagaggccaccactcaggctcacagacataccctcaggagctacgacaggcacacacagggctgtcaacgcagatgtcttgggagagcaagagggcggaaggaggctggttcttacaaaactggaccttggtcagttgctcccaaaacacagacaaggcccagccaggctctttcagaactccttggcatcctctttcttgttttggtccttaaattcctctccaccccaccaccttggccattttcaccctgaacacccgggtgaccccaacagcacgatctgcgtcacagctaaaggcgggagggcagggagtgctgctgaggtgggggtgggggggtctctcttgtgtcccctcctgttggttttcctccccaatgaggacagtacaaaagaggggctcaagaagttagggtttccctgccactcccagctccagatggagctcacatgtggtaaacccacactgggacattgtccctggacatacttcagtggctacagacagaggctgaaaatcaaggtcaaatctttccagaaaccccagggctaaactgccctccaaacagcccctgatcctgcctgaacttaaattcccaggcgcactcactagcatcttcctgccttcccagccacagaccagcttagcctgactgattaatagggagagatctgcaactcatatttagcactcaactggagggattcacaggtaagaattctattttaaaaaataaagtgcccaccagtacctgcatccaatgataggctaacaaaatttttctgtgcagttagttctgaaacagtaaactaagaaatgaactcaaaaaccaaacccagattcactaatcttgaaacatccaccaaaatagcaccaaacttttaaaccatgctcgcttcctggaaaataaaaatatcaattgtctttttaaacctctatagtattttgtcaatatttttttattacagcagagaatgtataaatattttattataaaccaaaggcctaaaataaacagtttagtaaatagttattacattacaaggaaaaacatctgtggaaactgctttccatgtaattattcttgctattttacattagcgctcaacgtgaatttctttggcactaatgtttcacttgttctaaatcttcctccttgttgctattattaaaatcttaaaaaggtgccaaatcttaaatgaagaaaaaaaaatgattcactagaaattattcatatcacagtgagccactactaaacctggcaggggtgcagtattttcggtgaaattaacataaaatatacaactgcaaattatccaggaaatagctatgttctttacggcatgcttttacattgggaaaaaaaaatgttcttcttcatctcgcacaaagccgcaaacagctccattccggcaagttttaaagggaaagtaatagatttgtcaaaggagcacgggctttgaaaacagactaacaaatagctcaggggtggatcagccttaggtaattaccagagacaacgtcagccctggacagccggagtagatagagaaggcaagaaaaacaacagcccgcagcttccttccccctcgattccagagaatgtatttcctctcgaaggcctcagcccttactcctaaacacaagaaaaactgtaacaccatgtaaaatgcaaatcttgctgtaaatattttataaaattgttgcatacatcccaaaagctataggtcttaattgagagcaggcgatttttctagtcaatatatggaaatggaaaatgctaatttgtgtttttctacttatgaaaaaccctggagaacagcaagccacaaatgcactcactttaatattataaatataatttggctccctctctaccatccccacagccctggcttttatctccccgtggctgcaggagagagacagagaatcgctttcacagcatcagcccgggaaggtggccttgcatgctgtgcagaggagggggatgtcaggcacagggctgtgtgcttccccactcccacctcttcaccccctagggattggcaggcagggatggaatatggcagggccacacgccaggaagcacagcccagccattctgttccagcaaggggcagaagcaagaaggatgcctggggtttcggccacgtggctcctctctgccctgttgggtcggcttgggcttcgggctccatccaaccacctaagagctctctctgggcatcgagagatctctctgaaggtcagccctggagcagctgtgatgaacaggagcagctggcaagatggctggagcactccaagttgggagtgtctgtttccaaaccacaaaaagagtaacgccactgccaatgttccccaagagcctgctcctctggccaggggaagatcagcccacagcccaggcctcacaatgcacctcccagtgggaacctgggggaggagggtctcctacctagagctatcctatctactccagttgccactagccacatgtgactactgagcaactgaaatggggtgggtctaccctgagacgtgctgtcagtccaaaatacacaccatattgttaaggtttagtacgataaaagaatgttaaaaaagtctcattcataatttttaagttgattatatggtaccatcataatattttggatatattgggttaaacaaaaagtatactctttaatttcaccggtttccttttaatttttttttaaatgtggctagtagaaaatttgaaattgcacttgtggctcgaatcctatttcctttggacagcctgctgtagaggatgctccagtctgccgtgtgcaagcctgcctggtgtccatgcatgtcggtgccgttctcttaggtaccgtgtaaatgggaggcccccaacattatgattctagagctctgcagttctcagagtttgggattctgtgattccaacaatctgcaagtctacagctctaagagggcacaatactcagagattatattactattggttctctgcatttaacacagactttacaaataccattatgaagagggcaggaccacagccctggccttgttcattcctcagtcaaaaagggctggaatatttggtaatcacagctaccttccccgcatcctctcctaaacccaaacatagctcaaccctccctacggcagcctcctgggtgactcccaccctcccttactctcccctgcccacaatgcagaacaggtcctcatggggagagcttgtcaatcacacacaacctccttccctgggtagtatctgcttcctggaaactgttcctcaacttctcctcacatgtgtgtatttgaagaaaacagccagaaagaagacaggagtggtgagaaggacacatttagagttaggtagcctgactatacctccaggctgtgcaactttctagctgtgagagcttaggtgtgttactgaacctctccttgcctccatttcctcatctgtcacatgggaacaataactcctactttataaaactttgagggaaaactgcaataatgcacgtaaggtgcctggccacagcacacactgcataaacagtggctcttattccttttaccatcattatcatttttgtcattccagagctggcacttggagcatcattcctgggggcagaagcagtgaagggaaacaggtgtcaggccagagtgaaaacctgtgtagaggagaaagggggctgcctggagatttgtgggccctcgctgctgacagaccccagctggctggtgagcacgcgcactggggacaaaactgggtagggcattccactgtacaggaaactgagcaagggaggccatcacgccaaaaggcccaggcctggccctgcaatcctggctgtgcagagacacctgaaagtccaaggtaagagctgtctgctgaagaaactcactgcttcacttccacatgcttttggaaatatccagggaaaaactgaagtggtcgggggtgatgttaggactggatgcagatggtttataactactgcagcactgtaaatggttgcttctaaagggtctgaaagtattaggctgaaccacatgaaaatgtcattttggtaggttcaaaactggatgctcaacttactatctttaacacctgaaagtggggtgactattggctggaatgaaaggctacatggtttcgaagaaagccccagtttctgaactgtgagttggaggccacacttcacaccaggcaccccgggctcagcagaaatccctccctaactgtacacatgtgtgtgcacacacatagacacacacagacatgcacacaacatgcttgtctgcctttgaaatcgcttacaggttggaagtaaattaaaaaccaagaaagaagggagggaaaagacacagacccatctaggcttgtgcaatggcaaatttccatgttccaaagaaaaaggctaggttacttggcagcccttaaaactcaagggaaacctaccctgcacactcaccccactgcaatcagtatacaacaatctgcgcccaagtgaagctcattgatgtaaaaggctccagtccctcagtgttccctgggactgtgctgagcacttgaccatagattccttaatcccctcatttcacaaatgtataaaccaagactcagagaggttaaggaacctgcagaaggtcacacagcaagtgagtggcagagccggatcccaagaccccagagccaggattcatagacaacatggaacacagatgggcttagcagcactgtgaataacagcccaaatccaggtacaacccaagcacccagcaacagtaaaatgcacattttcccatattcacacagtgcaacaaacacacagcaatacaaaggaacacactgctgatacacacacaacacggatggatctcaccaactaaatgtagagccaaagaagccagacacaaggaccacaggatgcatggggcgattcaacagaaatgacactcagaaacaggcaaaactcatccaccgtggaagacgtcagaacagtgattgcctttggtaggggtacaggggtatcagctagaaggaagcctgaagaaaattaccggtgaggaggaagtgctcaatttgttgatgtgggtgctggttacacaggtgtacacacttgtaaaactgtatcacgcaataccataagatctgagcccttcactgtatgtaagttaagcctcaattaaaaggggcaagaggccgggcgtggtggctcactcctgtaatcccagcactttgggaggctgaggcacttgaggtcaggagtttgagaccagcctggccaacatggtgaaaccctgtctctaccaaaaatacaaaaatcagccagacatggtggtgcatgcctgtaatcccagctactcaggaggctgaggcagaagagcggcttgaacccaggaggtggatctcagctcagtgcagtgagctgagatcgcgccacagcactccagcctgggcgacagagcaagactctgtccctaaaaaataataaataaaaattaaaaaaataaaataaaagggggcagatcctcccaagttatggaggcagcaaggaccctcactcgggcagctctccccacaggatgcgatgaattcgtgcagccctgcaggaagacaccccaaagccaagccagcagaaacaagagtcccctaaccagcctcacaattctaaactcagggtcagatagacacaattctgggcaacttctcggtctcagtcttccatggcaaaaagtgacaggaagggcccccacagcaggggagatgaggcccagcagggaaccatgcgccatggcctcccctctctcgtggggagcaggaaggagccggccgacgtttattacccgccagcggcaagattgactgcagccctcctctgcccacactgcgccattagctcgtaatggccccgaaggctccctcggccacagacccaggccggagtgagtgctccggctccgacaccaaagatactaatgactaccacattgccgaaataaatcaccgtcgctcaggaggggctccggcccggccggcggcctccaaacttcatttcacgaatttccccttaacactcagctgccttactgagggggttctcgggtggatgcatcatcggagaatttctctgatatgatgtttataaagaaggagaaaaaagaaaaaatggggactattaatctctgcaactccacaggagtccacattggtgggaatttggaggttggaacaaaatccttgtctgagactggacaaggcattcaaggattcggaagggcccatgtgctgacgacggactaaaagggtctcctagagaacccggctccctctaggtagatgctccaaattggggacaatgtggcatggtggtgaggcacacgggttccacagccataccacgcgggttcccatcctggctctgacatccgctggctgtgtcaccttgggcaggtcacttcacctctgtattcctcaatttccccatctacaaatggagagaataggggtatccctttggggctgatgggagaattaagtgtttagaacagggcctggcatataagtgctatacactcatttgggatcaatattactgttgttattatcgtgttaaaactctgaaacttcccacaggaacggaacctggttaacattgtgaaatgctccttactccaattcagccctggtattgttgaagtgtggatcccagaaggggagtgacttgttcaaggtcacaaggcacatggtggggacaggctggagtccaggctgtggctcgttcacataaaaggcagccctctctgtaaacatgcaacgtcaatgacacaggggtctgcgctgcacagcaagtgagccagggagagctgcaagcttctctctgggctcagtcagcctgtggtccccccttggctttgggacctgcaggcggtgctcaggaacacagccgcagctggagagcatcctccctgcctgtcttcctagaggaagcaggagccagggcggaggaaacagatgggcagcctcaggcaggggcttgttcctcaagaccctgagtcctcctcttctccctccttgacacacaaccttcatgtctctaggtgatctggagtctttcctataaacctcagctttggctgtggagacttgttccagctctgacttaactctggtcccagcactgggtcttgcatacagttggtgctcaattattgtttgggtgtcattacatctctgagccataaagctatgccagcctaggctccccggcttcctgtcctggaccagagatgctctgttctgaatctgactccctggaagccccgaaataacagagaggggctagagtccagttcatcactgcctccgccaggaaggcctcctgacttcttcagcactccctgatggctgttctgacaaccagtcctccccaagctgctcatggcctaattgcccacaccctcagttttgctgccagcccctggaaggcagggtgtgaggaggccctcctcatcttttctgcactcgaagagtttcaccgtagaagatgtccacagccttgacagcccaggctgagggtgggggtgaaggtcaggaggggctgcacagaaccaggtcagctggcaggtcatgaaggtgtccatagaccagggcacactcagcgagtttcgggtggggggcagtttcagcagattcctccaggtagcctaatgtgggagcagaagtgtaaaacccggcagccccatccaagtgccttctgcccaggaaaacaagtgcctgggctccagccgcaggcccagggcacaggctgggtgtggaccaaattccttctcagcagccatgcgtttccagcatgcaggaattgctcctgccgattcaaaaccaggtcagagaaaaccggctcttgtttccggcaggggtgagtgttcctcccagggaagggctccgcaaaagtctccaaaccgagcacaagagacaagtgggaaccaagcctcattccctcggtggccccgcggctgccaaaattactgacaaactgacctacaaagagagtttctattttgtgagcaaaccccaaaggttaacagcggagctgccggcgggcgatcagcaccgaggagcggaagcttccccagcagcgcccgcgtggagccctggcacctcggtttcgcagagaaacgtgtccctgaaatgccaaggagaaagggaggatgggaggaggaggttccgaaacactggtgcgagaaaagggtctggatgggaggataccagcccatcaccaagcagcctctctgtcccaaagttctggatcactgtcactatctggggcctgctgcagtgatctctggcagggccgccagggaccacaatgtaaatggtgtcccctagagttgtgcagtagacaacctgcacaaccatatcctgcaggcctgtgtcctgtggggttcctgtcactcaaagaatcttgcctccacacagcactggcttcaaggacgtgtaatacatgcagtcacacaggttcctgaatttagaaaagcccagcatatggttttataccctactgtcactgtctagattttttttttcttcagacgaagtctcactcttgtccccccggctggagtgcagtggtgtgatctcagcttgctgcgacctccgcctcccgggttcaagtgattctcctgcctcagcctccagagtagctgggattacaggcgcccgccaccacgcccagctaatttttgtgtttttagtagagacgcggtttcaccatgttggccaggctggtctcgaactcctgatctcaggtgatccgcccacctcggcctcccaaagtcctgggattatgggtgtaagccaccatgcccggcctagaaattcttaataattttctgacatacagcccacattttcatttggcatcaggtcccacaaattattcagctgatctttcctccatgtctgagagcaccagagccatgcctgaataatttataccaaaagtaagaaaatagcctccctccttcctcatcctccaagcagtccccttgtggcttgccaggagcaggggtagggcttggagagccctggggacaggcaagggcacaaggatgccagaaatctccaaagccaagccctgatacagggagaagcttttgatagcaggaacccatttgagacgaaaggcccttgggtgttctcgtacgataccggtgtctgagctgcaagaacagcccctggttgtggcagtggatgagcaacagaaagcaggccagataatatgcacaagcaggcggcaaacagggtcaccatcagcaccccgctggcgggcacccgggcccctcaccactgtctctcaacccaggcctctcaaagcacccacggccactgacatttcatcacatctgaccagccacctgtgagagagtgccctcaccattggggtcacagagggctgaagactggccacagccaccctccaggacaggcctgacccacacctcccctagccctggtagtggcacagtggtccaggacagagctttccagtgaaaacttcaaaggacagaacagagcaaggcgtcacccaaccccatctagttggcccacgggcacctgccttgaacacgctgccacactgcagtttgagaaccagtgatctagtggcctcgtttctagtctccatcaatattaaatagttgcatcacctcagcagggttcctaaacctcactctatttctgtatccataaaaggggcatcctgggtttgtgcaagagctcagcttttttgagggatgcacaatcacggtcagtgcaatccctgctccctctgcccctgtcccaacttccagtctggccatctggtcatgcaacctgagatccttctcccatcctcaaggctcagaattttgcattgctctgcccctgtgtctgaccaccaaacaccaagaagcctgctgcatccaccccattcctgggctgccacgaccactgtccctactggtgtgatgaaagccggacactgtcccctccagaacccagactgtccacatcaccagatcctgggagggcagaatcagaatgcaaaggaacagttgaaagaaaaataaatcacaccccagaggaaagggggaaatgtattaccactttcaacttttgcctcggatgctgcctggcttaatgtattggcttccatgcccataacagcccactcttctcctcttgccaagggtattgagggttctagaaatagtcccggccctgggtctgggccactgggtcccaaagtcccagctcccaggttcccaccgagctccaggtctcaccaccagcagatgtagtatcgaccagaatttcccagacttccctggagatacaaatcctgggggtggaggatgcttgttggctacccagatttccaggcctcctcacacccaagttccatctcttctctcgttcattaaatacttattgaatgagatggaacttgggcgggtttgcatccatcccagcctctggccagctgtgcaacctcgggaaagtgtctgtccctctcaaagcctcagcttcctgaaaagtaaaatggaccacttagtcgtgaagcttccagctttttcttggcttcaacagagcagcaagccccttctagacactgctccaaacaaagagagaactccaactcagccttctaaaagagaaccaagcccatcccacctccttccattccccagaacagaccctcaggcccccttctgagcgacagcagacactccctcgggagaattaaaatactatttttcaataaatgaagccccggccctgcaccagccctggaagactgtgagctgggcgaggtggcttcctgcatgtgcctcacttattaagacattgccactctgaagagtggagtcattcccaaggcccccgttgtcactggcaggcagcggttgactgacaagtgtcagttgcagcttgctgagcagcagaggccaatagactgtgaaacaaggagcagatgtgctaatgacaaaactttccaaactgaaaacacaaggagcagattcccgggaaaggtgtttccccaacctctacctggtgatgggacgaatgagaaaaacactagccaaacacagagctcaaagtcatcaagacttcgtaatgagaatgcaacaggggctgagcagaaagagggaagggccgctgtcacagccgcgtgcacctgcagccagcgccattgtcatagcagctctgaggatgtaacaagaagcaagcaactgtcatcaaactgtaaacagagtgaaagctgcagaaggacatgtaggagtcactttcctatgggaaagtcccatcctttggagttagagcaaaataaagtcctctcttagacgctctcctgtgcagtaagaagaaacatctgtaatgcccaccgacagcagaaggggcctggcatgagggtatgtgactgggaagacacacgctggacctagagaagccagcttaagagcgaggaaatggtgtcatgccaagcccatggttagaattcagtaacacttgctgaggagtggagggacagaaagagtagaaaatagggtaaccagcaaagttgatatgcagaatgtttcaacaactggtgcaccagggtccccaccaacctgaattatcccagggggtgatgtggtagccctgatggactgggggttatcccctcaagtgctggggatgcccagggggctcaggtcccagagggagaacctgtggataggggtctcagggcagaaactatttgctaggtggttaggaagcacatgaatgttttatcaaacagtacagtggtactggtgcataccagctaaggtgtcctgacacaggtgccttggtgaacagtgatcacaggggccctgggatgggtgagaacacagcgaggaacattctaactatcttttcacttatatgttcctttaactgactgagtaatgctcctgccatctctgaaacaaggcctcccaagtctccgagcagagaagtggggaccatgcaagccgtgtgaaggccattggaaccagagcagagcccaccgggtgggggtctgcagggagaggaggtcaccaggagaaagaaatgagctgccccaggagcaggagacagagccagatgtctgaacccagattctgatcctgatgctgcagaaagaagccccaaaatgttttatggtgaaacgttaaatgttttggatttttttttttttttttgtaaaacagatcttgacagttgagagagtcagagtccttcattcacacaggtgactactgagttgttgttttgtttttcctttaaggaagcaggccttatgataaacccttcatgaaaaccccactcaggatagcattttttgtggtccttgcatagtgaaaggtgccttttgtggctcactgcagccctgcataacaggccacagaattcagagttcataaacataagaagattaactaagcccagcatggactgaggacctcaacttcagcatcttttaaggattcatgttatcagtagaaatgactacctttttcccaaagctatgggttctttactgtgtatgttgatgtttgatgggaatctaatcctaagccagattctgggggcagatcaccaaaactgaagaagctgggtttgtgtcacagagcttcttgatttcaatcagcccctgcagctttaaaagagcagcccacggaatcctcttcccaaagtgaaagggctggataatggggttgttttagtcatatgaaagtaaggatcattctgtatcttaataggcccataattaattcacacattcaactgttaagtccagaaatatgttcatgttgacaatttgcatttgatgcttcaaaaacaatctggcatgtttttatttgcctcgaaatctcaggaacatccacccctttccattatccatccaaatgctacaattccacaacagcttcctaaggccccacctgtgggaatgcggggagggggctcaagatgcccagtcaggagaagtggtgttagtgcgagagctgtcctcctttgaaggacaagaccaccatatggccagtggaatttccgtctgcccctcccaactcccatgacaacttttagccctaggcatcaatgactggagatcattctaccaccccatatcttcaacactggatcagtgattttcccctcaacccccaagcaccagttatgccccacctttgcccagctcctggtctacactatgagtgcacccatctgatatgtcaggtgggaccccaccccagcctgtctacctcatcagctcctaggaggataaaaccagagtgagaaggaccatcggagggaagaatataaaaagcaatgctggcacaggaacaagggatcgttagtatcaacgtttactgctaggcttgatttacaactgccaccaacaggcgagtcagaagaggaggggagggggaaggaggaggggcctgagctcaagccctcaaactcttagctccaatttccacaccctgagtcctacaagctagcacagaagttgctgtggaataaaacaatgtttatggaggttctcagttgcctgtgctgcttccagatcactcccacagatgtactattccctattcctctgtcgaagtacaactaaaaccctgaacattatatatgaaagaaacagaagaagattcagaaaggcagagagaagaagccagaccagccagggacccaaggagtgacaaagcggtgaggatcctgggttttctttttgcttcatatatcccagactaggacctgacaaaactggcaacccagaaacaccaacaaggattttgctttaagccttaaccaaaccccactctttctagccaaaggaccaggaaagatttttgcctggcaaaacagaaaacgtttagacaataacagctctgctccaggcaaaccccacagaagaaaactatgaccccaccaccatccactccagcaaaggctgaatggagatctgagactgccgtgctggcaaggcttatataatgaggcactcaccgcccgctcttcccatccctgttaatgtggcatcagagaaaccctagcagggagccaagacagtcatacttgctgggcagtaacaaggcctttccccatggtgtcagtagagaccacatggggagcctggactcccctcctacctaacagtaacaagtgccctaacccatcctcctggtatagtggagaccatgtggagagcagaaatgatgcattcctaccacgactgctcagagaggtatgagtggagacctagggaggaaacgagcctggaattctacccacacctggcagtagcaagatggcatctgcaccccttctgcactggagtggggtcaaaggaagccagctaaaacagagggtttaaataagatccacagtgtcattatgtaatacataaagatttcaatcaaaaatcatctatcctaccaagaaacaagatctcaaattcaatggcaaaaaagtcaatcaatatatgccaaaatcaaaatgacagagatgttggaattatctaatggggagtttaaaggaggcatcatagaattacgtcaataaacaattatgatcatccttgaaacaagtggaaaaaaaaagaagtccagcaaagacctagatagttttgacaaagaaataggagatacaaggaggcactaaatggaaattttagaaatggataaaggagaaaatcttaaaacccaatgaataggcctaacagcagaagagagaagagaaaaaaagaatcagtgaaataggagatagaataataaaaatcacccagagtttcaggggccagtgggactataacatttttgtgattcaagtcccagaaggagataaaaaaaaaagagggcaggattgaaaatgtactcaaaagagtgatggctgaaaaattcccaaatttggcaagagatgtagatgtattcgagaagctgagtgaaactcaaaaggaataaacacaaggaaatccacaccaagacaaatcatattccaactcctgaaaactccaggacaggaaaaaatcttgaaagcagctggagaaaaaatgacaccttatacacagtgaaaaaataattcaaatgacagcagatttctcattagaaaccatggaggcaagaaggaagtggcagagcatttttcaactgctgaataaaaaagaactgtcaatccagagttcttctacatccagtgaaaatgaccttcaagaatcaagggaaaattgagatactctcagataaaagaaaactaagagaatgcgtcaccagcagaatcaccctaaaaagaatggttaaaggaagttttctaaacagagaggaaatgattggaacattaggtagtaagaaagaacatggtaaggaaattttactgtagataccactaattccccttctcttcttgagttttctaaattatgtttgatgtctaatgtaaaatgttaacactgtctgatgtagtactaaatatatgcagaagaaatagttaagacagtcataagtagggaagagtaaagggacctacgggaggtaacttttctacatttcacttgaactggtaagattatgacaccagtagtctttgataagttatgtgtatataatataatacctacagtaatcatgataaaaagctgtatcaagaaatgaaaacactacagataaaccaaaataaaattcttaaaaatgttcaagtaagtcacagaaaggaaaaaagtaaaccacaaatgaaaaacagaaaataaaatataaaatggcagactgaagctctcacatatcattaacaacattaaatataaataacctaactatactaattaaaagatgaagattggcagactggaaggaaaatgactcacctatgtgctgtctacaaaaaactcacttaaaatataacaatactggcaggttgaaagtaaaagaatgtaaaaggatatatcttgcaaacattcattgaaagaaagcaaaaaggctatattaatattatataatgaaggcttcagaacaaaaaattagcaagaaagaaaagaacattaaacaatgataaaggggtcaatctaccaagaaaatcttaaatatgtatgcaccaaacaacagagctgcaaaatatgctaagcaaaagctaatagagctgacagaagaaatagacatatccacaattatagtaggaaacttcagaacctttctctcaatgactgataggacaactacgcagaaaatcagaaaagatacagaagaactcaaaatcattgaccaacaggatctaatagacatttatacaacactccacccaacaataacagaatgcacattttttcaaatgcgtagagaacaaataccaagacagaccatatcatgggtcataaaacaaatgtcaacatatttaaaataactgaaatcatacatagtgttttttcctatcacaatggaaccaaactagaaattaatagcagaaaggcaggaaagcctccaaacaatagaaactatacgacgtacctctaaataatcatggatcaaagaggaagctcatgggaattttttaatacactgaactgaacaaaaaaataaactacaacatgtcaaaattcgtgggacacagctaagtaaaggctaagagggaaatgtatagcaataaatgcttaataaagagaaaaagtctcaaatcattaattaagcttccacctcaaagacctagaaaaagatgaagataaacatagaacaagcagaatgcagaaaataataaggaaaagatcagaaaccctgaaacagaaaacagtaaaacaaaattgaaaatcaattaaacaaacaggtggtgttttaaaagattgataaaattgacaattcttttaagaaaactaacaaaaaaagagagaagacacagattaccaatatcaagaatgaaactgaggatatcactacagacactacagacatcaaaagaataataagggaataatactatgaaaaactctacatacataaatttgataaattagatgaaatgatctgatttctcaaaaaatacaaactaccagaatacacataataagaaatagatattttgaatagtcctattctattaaggaaatggaattcataatttaaaactccctgtaaagaaatccccagacccaggtgttttactggataaatctaacaaatgtttaaagaagaatcaacaccaattctacataacttcttttggaaaacagaagaggaaagggcacttcccagtttatttcagtaaattaatattgccctatattaaaacccggtcaaagacaggacaagaataaaacttcagaccaatatccctcataaacacagatacaaaaatccctgacgaagtattagcaaatagcagttagcaatatataaaaagaagtatacaccatgaccaaatgagatatatatatatcaaggatgcaaggcttactcaatatttgaaaactggtcaatataatccaccatattaacatacttaagaaaaagtgcatggtctcacaataggtacagtaaaaaaaaaaaaaaaagacaaaaacttcaggcatttgacaaaatccaacacccattcatggtaaaaaacaaacaaacaaacaaacaaaaaatgcttagatagaaggagaattcctcaacttgataaggagtatctacaaagaaaacctatagctgttattttacttaatcgtagaagactgaatgttgtctcccttaagatcagaaataaggcaaacatacccactctcacactactgttactcagcatagtgccagtaggtctagccagggcaataaggcaagaaaaggaaataaaaggcatacagatagttaagaaataaataaaactgtcccaatttacagatggcatgattgtctatgctgaaaatcccatagaatctacagaaaaattcctacaactaagttgagcaaagtcaagcaatacaaaaatgaacattcaaaaaccaactgtatttctatatactagcaataaacacatgaacactgaaattaaaaatgcaataccatttataattgctcaaaaaattaaaataattagatacatctaacaaaacctgtaccaaattaggatgttgaaaactttaaaaaaaaaaaaaaagatgaaagaaatcacaggtctaaataaatggagaaacataccatgttaatggattagaagactcaagacagtaaagatgtcatttctccccaaatcaatatacacatttaacatgattccagtcaaaattacagcaagaattttggtagatacagacaagattattctaagatatatatggaaaggcaaaaagagctagatagcaacaattttgaaaaagacaatcaataaagaaggaatcagtttattcaattccaaaacttattctatagctatagtaatcaagactatattgtatttggcagagggataggcacatacatcagtggaacccagaaacagacccacagaaatatgctcaactgatatttaacaaaggtgcaaaaacaattcaatggagaggctggacaatgtggctcatgcctgtaatcccagtgctttggaaagctgaagcaagaagattgcttgaagccaggagttcaacaccagatgggcaacatagtgagatccttctccacaaaaatttaaaaattagccagatgtggtggcctatgcctgtagtcctagctattttgttaggggggaagttggtgctgaggcaggaggattgcttgagcccaagagttcaaggcttcagtgagctatgatcatgctacaaacactccagcctggtcgacagagctagatcttgtctctaaaaacaaacaaagcaattcaatagaagaatgatagccttttcatcaaatgatacaggatcaactggacattcataggcaaaaataaaaacaaaaacaaaaaacttcaacctaagtcttatattgtatataaaaactaactcaaaatggaccatggcctaaaataaaactataaaactttcaggaaaaaaaaaataggagaaaatctttgcaccaaaggtataatccataaaggaaaaattgacaaatctaattaaacaaaattaaaaacttttattctgcaaaagctcctcttaagataaaatgacaagctccagactgggaaaaatatttgctgaccacatacctaacaaaggactagtacttagaatacataaagaactctcaaaactaaatggtaaaaaagcaaatgatccaattagacaatgggcaaaatttatgaaggaacatttcatcaaagaggaatggctggcaaataagcccatgaaaagatgttcaacatcattagccattaaggaaatgcaaattaaaagcacaatgagatatcacaatgcaactatcagattggctaaactaaacaaatagtgacagaacaaatgctggtgagaacgtagagaaatgtgatctttcctacattgctggtaggaatgtaaaatggcacagccactgtggaaaacagtctggcaatttcttaaaaagtcaaacatgcaagtactacagacctagcaattgcactcttgggaatttacccccaaaataacgaaaacttaaatataattccatttatataacagtcttgaaatgataaaattatagaaacagagaagagagtagtggtttccaaggattatgggtaggagggaagtgtctatggctataaaagggcaacgggagggattcttgtggcaatggaaatgttttgtagcttgactgtatcaatgtcaatatcctggatgtgatattgtactctagttttgcaagatgttactgttgggagaaactgggtaaagtgtacagaggacctctatgtgaatctgcatgtgaatatacaattatctcaaaataagaactttattgtctttaagctaaaaatgtttaaaggacaaataaaagcccaggaggggctttaaaagaagggggaatggatagggagcagtggctcacaacagtaatcccagcactttgggaggctctggcgggtgtatcacctgaggtcaggagttcaaggccagcctggccaacatggtgaaaccccatctctactaataaaacaaaaactggccaggtgtggtgacgcttgcctgtaatctcagttactcaggaggctgaggcaggagaatcacttgaacctgggaggcagaggttgcagtgaggcgagatcgtgccattgcactccagcctgggcaacaagaaagaaactccatctcacacacacacacacacacacacacacacacacacggggcaggggggtaatgagcaccagcattcttcccaggctaactggcttgaggcgtggagagggtgcagggttgccaggtaaaatacaggacggcaggcaaatgcaaatttcggacaagaaataatgttttagtagagtatgtcccatgcaaatgaatggagacatacttcgactaaaaatgtattggctgtttatttgtaattcaaacttacttagcctgtatttttagtgggtaaatctggacacctagaggggaaggatgggacaggagggttctggagcccccagggacagtgggctgaaaaaggcagggtggaaacagggagaagtaaaagagaatgagcaaagggatgccagaggaccagaaaggcacgcaggctaggcagtcccatggtgggggcagagggcagtcacaagctgggaggcctgaagtcccccagctgctggtgaaacaaccctgtgtggggcaatcaggcagaaaccagaggtctaaagagcagatgctggagtctcggtaacagggggcctggcagcctgaccaaggggctcctctaggcaccaggagcatcacccagttaagcccaggccaacccctgggcctctgtcgccatgacctggctccacccaaatggtctcgcctccctacagggaaaggacgtgctgagcagtgggttcaagtgttcaggtcggtgggcagccacgtgcttgaccaaaacaaaaaatgctttgatgagactttgctatcagcctgcaagtcagttccagggaggccgctgcatacgtttcattttcaccttgctcccacacacacccaggacccgcccttctcttctgtgtggtacccatcactattggacacaatcaggagctcttacttgttctcttagtgaacacctgtctgctcccaccagacactatgctctgggacaaaatggcaaagactgttctgcttgctgcaatattcatgcttactgcctggcacacagtaggtattcaagaaagaaaaataacttggaactgggggacattatgttaagtggaataagtcaggcacagaaagacaaatgtcccatgttctcactcatttgtaggagctaaaatttaaaacaactgaactcatggagatagagtgcagagtgatggtcagcagatgctaggaagggtagcagggagggaggggaagtggggatggttagtgggtacaaaaatatagttcgacagaatcagtaagatctagtatttgatagcacaacagggtgactacagtcaacaatcatttattgtacattttaaaataactaaaagagtataattggattgtttgtagcacaaagaaagaataaatgcttcaggtgatagataccccattttccctgatgtgattattatatattgcatgcctgtatcgaaagatctcatgtactccataaatatatacacctattatgtacccataaaaattaaaaattaaaaaaagaaaactgaatgaatgaaggaataaatgaaaaatcggcttgattggagctactccttctgggtctgtcctccaggcccagccccttggagtcttgacaaggcagagagagggggccattcttcttgcagaaagccctcaggagcatcctctgagctgataagcactgacatctggtatataggcttagcatggccggtttttcctctctaaactgggactctatcatcatcatcatctaataacactaatacaatattgatagatagaatttattcagaacttaacatgtgccaggcagtgtgctgggaccttttcatacattttaatttatttaatcctccaaacagtgccaaccagtaggtgtggtgagttgcactgtttgtgctgccccttcttgtggaaataaaagccctctttcttttcaataatacccttcctacttccactgctggggggcagacacccaggaagggcaggggtcaccagcctgaccagataaccagctccacctccctggccataacgattggctcatgggcagcttcaggacgctcctgaggccagtggaagaggccttccactttctccccgctgggccccaaggatccaaggccaggtctgaggctctgaagcccactgggtgctcaggacagaggggaccaagctctggggccactggccacaggacccttgttgtctgctgttattccagtaaggctcagccagaagcaggtatgagggaaattgcccatgcatcagctgctgccaagcagccaaatgacatcaaaggatgctcaacaaagtcagttcaacaatccaggccaccaagcccatgtgacatgacagcaagaagagaagaacatgcttatgagccggctcaagcaagatgatgccagggctccagtgccagcccctccaggaccagctccatcagcatctccctcacttccatccttcctcttcccctccctgctggatctctctcccgaacctagaaacacactttggtctctctctcttaaaaatgcaaatacttcctgttacctttggagccttccagctcccacttctctccctcctctcccagcctggaacccggaaagtccactgacactgctgcccacccccatctcctcctgaccccttccatctgatgccactgaccctgctcacacccaggacacaatggccacttgttgctgagccacacagaccctcttcagcctccctcccagtgcacttttcacactgcacccaattgatattcctggaaacactgctccttcagcaccaaccaccctacactcctcactctccaggctcctcccagatgttctcaccatctatgctgatgccgctggatcctcttccccagacagggccctgctggccctcagatctccatgggtatcttgtgcaaggccacattatcacaaacactcaagcccaccaaacgtgatgagccttcaggtgcaggggttaagggcgcaggccccgagtcacactggctgagttcaggtccctaccctgaaactagcaacattggacatgacacctcaactccccatggataaaaggaagtaatgacagcacgtctcacagggtgttgtgagggtgaagtgtgataacacctgcagatatggaaagaagggcctggtgctgagtaagcttcattagatggtactgactgatacggtttagctctgtgtccccacccaaatttcatctcgaattgtaatccccatgtgtggagggagagacctgtaatccccacgtgtcgagagaggaaggtgattggatcatggaggtggtttccccaatgctgttctcatgaatgagttctcacaagatctgatggtttcataaggtgctcttccccctttgctttcttctctctctctcctgccgccatgtaagacgtgcttgcttccccttccactatgattgtaagtttcctgaggcctccccagccctgcagaactgtgagtcaattaaacctttttcttttataaatcacccagtcttgggtagatccttacaacagtgtgagaatggactgctacatgaaccactgctagcatcattgtcttctctgccagtccctaagagctcttcctctggcatggtatcatctgccacctgtcacccaaaacctggtcacctgagacctttgagtcttcctaacttctccccctcccatgtccactcaataagcaaatcctgctggttatgtctcttaaatgtttctccagcccatatcctcctatccaacatcctcaccttctctcacctactctacctcatcccctttgctgtgatccacccacctcctgcctcaaagtttgttctgttgcagtactgaattgtgtacagtgtccctacatactacatggacctcttttctctataattggcttgtactagtttctttgcctggaattcccctcccaccttacttcttatactctgagaccctgattaggtgtaacctcttccaggaagttttcctggaatacccagattgggcaacatgcctgtcctctgagctcccttatcttagacttgtgacgttacattgaccttgcaggttatcatctcctgagctgggttagcggcccctcacagagcccaccgaggattttaatagtgtttactgaacatgaaggtatgaggttactactagaagaaacctcaatgacagaggccttcccccaaaacaaacaaacaaacacatacgcatacaaaaggaactcaagaaaatgagaaattttccactattttaaaattcagaactgatggattctccatagacctaaacagcttcctcgaatgaaccaacgggattcaaagtcagggaaaccaagtcctttgggctggttctctcagccaggaagactgttgagggggaagtgactatgccctagtttgggggtttggcaacgaaaaaaaaaagaataaaaaagaattggattatagtcttgctgtacaggcttgttattctgacagaacagttccagaacctgaaacatgatctctggagggagagggagacatttttatcacatattaaggttagacagatgttttgggtctggtgttacctgaatcaaaagcaccattgaagagcctgacacagcccggttcagcaacacgtgatcctggcagaaaggagacaggaacccctttttcttttcatgttcatgagattttcctctgtggttctatttgggttttttgtatctccctggagctggggcgagacactgacttccactccagactgtcctccttggaccagagactccttcccctccaaaatgctgcaggctgggccttcagcacggggccagggtccaaatggcagcttgaacagtgggccctggctctgcaaggtggtttgaaagtatctccagggatgtgcttcataaagacttgtaaggtagaaaaaccctctctctgtctgtctccctctttccctctctctcttctacacacacacacacacacacacacacacaccacacacacacaacacacacatacacacacatacacatacacacacagacacacacatacacatacacacacagacacatacacacacagacacaaaacacatgcctccctccaggttggccagggccagtcctgccacagtgacaggggagggctggggacaagaggacacacaaggacagaagctggcactggggacactttaagagcctgggcaggaggcaggaggggttgattttccaaacacccacttcctcccccatgtatttgcccctgacagcagagcccagcccttgaaggcacccagggaaagggccggcgtgagcatgaaaagcaggcctccggaatgactaatgccccaccgggacaggcctggctctggcctggctgcccgccagagagtccacagccactttccaaggacagcaagggcaagcgttcctgacaagattccctgaggaccatcccttcccagccctgaccctccccggggctcccccaaggggcccgtgaggccctgcgtgaggacgtccaggggcccagaggctgagtcactcccttggggccaacctgggtcatggcaagtttgttatctcaaggacaagttctcagaccccttatccagccatccccacccaaaacaaactaaaagtaaggcctctccagcaaatcggcttcctgggggtctccagactcaggccctgccccccagggtgaggtgccatgtgccccaggagggcagtgtacatacattatacatatatgttcaacacatgtgggcagacccactgctcctcccttcccagccgtgggggaccagcttcctctgggccaagccccccataagcctccctctctctccttcagcagcccccccggggagcccaaggcaggggcctcctgcagagcaatttcctggggcggcagaggtgggagtcatcctcccagagtcctcggagggggtgaaggggaggtggggaaagggcgactgggcagagctgggtcaacccggcaggaggccacagcacagagctctgggctgctccaagtttttcatgtgccttctgggggaggaagtgtcaaagccatttcaaaagctgggggagtcccagggaaggggcctcattctccatgcggaggggggatttcaaaggagaccctgctattgaaaggtttccaaagaccctcgcctttctatcagatccaaatcactcccctccaagcagcagccaggagaggggtgctgggaaaatgtttccaaggagacatgtccctgagtcatcataactcccagggtctccgggctgcagagccatgcagaggcccccgctataaaaaggccggtttaccgccccgcaggggagctctccagcagtccgggtcccaggggaggcctgcctcagacccccaagtgccctgagtttatgagaaggctgcagagctgaacagggccacttctacccaccaagtccccctggtgccactaagggggacttttacccccgtcagcggcagggcagccactctgggctcagaccatttagcaggagaagccatccactgggacactgggccccaaaagatttactgggattgcagagccagccccaaaccaggcctgcagtgtctgcctctcaccatttccccagcagccttcccaagccaccagggccagccagaatcacagcacaagccacatctaagttccatcaactcctcttctccccctgccctgttcactcaccccaggaccacaccaggtgggtcttcgttctcttcccaactggttccttctcaacaccgcagccagattcttcttcctaaggctcaggccaggatataccctgctctgaaaccttcaatggctccctagcgcttaagtccaaggtttaaactcaggtacccacagggaccaggctggagacttaactgagcaagaccatgatgcctgggaatgcatgccttgcctacatacaggaaactgctgctgctgctaagtcacgccaggtgggaatgatgattgcgggaatgtgaagcccttgctgccacctcttgtggtttttcaagagaagcctagtaaaccatagccaaggggcccccaaagttggaccctggcctacggggtgaaggacaaaccctaacccctccacttggtatcggaggtgctccatggctcaccccaaccccctccccattctcactccccacaatgcctcagtcttggccaagccaagcacctacagccccccagactcacctgctctgctcaccccccatcctgctataggcagtggctcatcaccctcgcagcctggcagaaacccattgttccagagcctcctcctgatgttcagccatctctccgaaggcaacgtcccccctcttcatccttcaatgcccagggggccctgttctgggagcacccacatcactgcactgcagttacctgcatgcccatcagccttcccctggagagggaaccctgaggtctctcccaccacaggccctggcaggggctccaaacacaatggagggaccctagctgtggttcagactctgcctccattactcaggctggaaggacttgggtaactcacgtaacctctctaagccccgggttcctcatctgtcagatggggaactagtgcccatgtaaagtgcctggcacatagaaaggctgagtcagtagcagctgttagcatccttattcaatgtgacctctttgctgcatgctatgtgcagtgtcttctatgggatgatctctgaagcagagaccatgtcccctgtactcccgtcacccacagagaccgctgcaactctcaacatgccataggtgctcagtcaaggtcctctggtagactgggttgatgaggctcggggagggcaggcaggtagggagtgcaggttagagcgagagggactgcccagccaccggaggtctggctcacccggggttccatgccgcagtgaactggaatctgcactcggggaccaaccaaccactccctgctgcctgctctccaggcctccaactcccacgttcctgggctccaggtcagctgacagcgctgcagggcaggaatgggcaaggggacctgtccagccccccagccaaggcgccttccctcagaagcccggcccacagctcatacacaggcccaaatgcccctcacaccctccttttgtgtttcccacaactctagttaagagcaacccccttgccttgcacttgaggacacatagcttccaggctctgcactaaaggcaaggtagaagagaggagggagggggcagaaacacctcagaaatcactgcagtccaattagccaggcttgcgcccttcatgcttacaaacaggaacgcgcattaacatctgctacaaaagcaaacatttttagatatcttcatcttcacctccctgacactccgtgaaaggactctcagcagccagtgactgacaggggagtgccccttcttatccttcagcagggggctttcagacggagaaattaagaagccaccaatctccctgtcaggccaagctcccacagcccccacctgctcttcctgggcccctcctccccactctccgccaggtgagccccaccacacacacgattgggagtcagtggctgcaggagactggctccaaggcactgggggtagaggctgtcagataggttgggggtcagggggactggccaatgctgtggctaggtagggaccaggggacccatacctgccctgagagcaccttcactaaagaagggcctttgcaatgcaaaccttaaacaaaaccttgatggctgtacaaatttggagcaaactccaactctcatacaccactggtgggggcgttaagtccatacaaccacttcagaaatgtatttgtcagcatttactaaaggtgaacatcatttaacctgtgactcagcaagtccatccaaatcctatattcccattttatatacatatttacacatataaagaatatagtatataacagtatataatgtattatatataaacgcaaaatataatatctatatattcctataatcacaataaaatcacatacatatgttcatcagtagatatgtacatggggccaggtatggtgactcatgcctgtaatcccagaaattcgggaggctgagatgggcagatcacttgaggtcaggagtttgagaccagcctggccaacatagtgaaaccctgtctctactaaaagtacaaaaaaattagccaggggagatgctgcatgcctgtagtaccagctgcctgggaggctgaggcaggagaatcacttgaacctgcgaggcggaggttgcagtgggcagagatcgtgccactgcactccagcctgggtgacagagtgagactctgtctcaaaaaaaaccaaaccaaaccaaaacaaaagaagacatgtccatgaatatgccagcactatttcagaatgggcccatcaagaatcaaacagataaagagtggttggcatgctcctgtgacagattattatacaccaatgagaggcatgatctctaactagaggcaataatgtgaaaagtgaaagatgtcaggtgcaaacgagtagaaactgtgattccatttccataaactagaaatcaggcaaaaccaacctatattattagacatcagcatcgtgatgacctgttggtggtaagggagggcctgaaggagcccaagagggaagcttctgaaatgctggaaatagtctgtttcttgatctgtgtgtgggttacacaagtgtgtttagttcatgaaaattcattaagcttctcacttatgagaagttttctaaatgtacgcagtaaagggttttgtaaaccagtactccgatggcatagctgttaagacaacaatgaaaagatgctagaagaagaaaaacagagatgaagtaaagaagtagttcaggccaggcgtggtggctcacgcctataatcccagcactttgggaggccaaggcgggtggatcacgaggtcaggagttcaagaccagcctgaccaagatggtgaaaaattagccaggcgcagtggcaggtgcctgtaatcccagctacttgggaggctgaggcaggaaaatcgcttgaacccgggtggcagaggttgcagtgagcaaagattgcaccactgcactccagcctgggtgacagagtgaggctctgtctaaaataaaaaattaacaaaaagatgaagttcaacccatggctgcaacttcactgctcagactagagtcttggagaaagtgatcacatgtccaacaaagacccagggtaccaggcttcttgaagctctcccaggccccagcccatcccaggccagccccttcccttagaacctccatgcctatcagaacatcagaacatccagctgtgccctctcctacaatgagggcacccctagctgccaaggagaccacatccacccatccaaggtagaggggacttcacagcttcccaggtctcttgtgccaagtgtgtgaactccatagaactttgcaagctgcccttctagagaggctgaattttccaaagtccaaaaccacttgaagaggaatgggaaaagtactgaaataactttgtaagcgttctgttttgacaatgtgcctgaggaattcaccatgttgagtagggaaatgtgagcagttaaatctattcaatgtcatgacacacaaaattgaagcataattgctcctgagtgcttgacaattggaaagcactttgtttcagaaacggagggaaatttatgctggaaaatggaagagattgtcaaaagtttgattataatgtgagtggagctgcgacaagaaggctcagatggagaaagggcccccattctgacattttcactcccatgtgcaatgtctcagaaacagcagcagtgactctgtcctttggcctaaaagccagtaaaatgatgattggaaccgcaaatttaaaaccccaaagagtagctccagcatggctgggaggaaatgctctcttaccaatcatgtggttggcaacgtggatttggatctctctctcgttctcgaaggtcatctggcacttgatgcactggtatgtctttttctgtttggaaaccaaaaataaaagatttagagaggcaggaggtaggaaaaaggagaaagcaaaagttcctagggggcctgggtcaagactttccagaatggttccagtcccctcctaggtctccccaggccattctcttcccaccttcctctaaatccagctctaccagactgaggaaggggcatgaagctacattccaagggagctgcttctctgctagatctgggaaaactgccatctcaaggtgaagctttaagggagctgaggggaggcctccttgcttagaagggcaaatccatctacccatgcccccatccatccaaacatccacccatccatcctccatctacccatccacccatctacatacacaatcacccatctacccattcatccatttacatacacacccatccatccactcattcatctatccatctaccatccatcctccatctacccatccatccatatacccatccatccacctacatacacacccaccaatagacccatccatccatcctccatctacccatccatccatatacccatccatccatctacatatacacccaccaatagacccatccatccatcctccatctacccatccatccatctacataatacccacccatcctccatctacccatccattcatctacatacacacccaccaatagacccatccatccatcctccatctacccatccatccatatacccatccatcctccatctacccatccatccatatacccatccatccatctacatatacacccaccaatagacccatccatccatcctccatctacccatccatccatctacataatacccacccatcctccatctacccatccattcatctacatacacacccacctatccacccatccatccatcctccatctacccatcaatccattttccatctacccatccatccatctactccacccatccatccatcctccatctacccatccatccatctacatacatacccacccatccatcctccatctacccatccatccatctacatacatacccacccatccatcctccatctacccatccatccatctacatacatacccacccatccatccatcctccatctacctatccatccatatactccacccatccatccatcctccatctacccatccatccatctacatatatacccacccatccatcctccatctacccattcatctgtctatatacatacccacccatccacccatcaatccatcctccatctacccatccatccatctattccacccatccatccatcctccatctacccatccatttatctatactcactcacccatccacccatactccatctacccgtccgtctccccacccatacatctacacacacacatacccatatacccattcatccatcctccatctacccatccatccatccatccatccatcttctatctacccgcccatccatctacataaacacccacccacccatccacccatctacatacattcccacccatctacccagtcatccatttacatacacacccatccatccacccattcatccatccatccaaccatccatcctccatctacccatccatccatatatccatccacccatctacatacacacccaccaatagacccatccatccatcctccatctacccatccatccatctactccacccatccatccatcctccatctacctatccatccatctacatacatacccacccatccatcttccatctacccatccattcatctatatacatacccacccatccacctatccatccaccctccatctacccatccatccatctactccaaccatccatccatcgtccatctacccatccatccatctacatacatacccacccatccacccatccatccatccttcatctacccacccatttatctacatactcacacacccatccacccatactccatctacccatccatctccctatccacacatctacacacacacatacccatctacccattcatccatcttccatctacccacgcatccatcctctatctacccacccatccatctacatacacatccacccatctacccattcatccacacacacatccacccatccacgcatacacccacccatccatccatctattcacccatcagtctatccatccatccacctacctattgtctgtctacccattcgtccatctacacacatatccatccatccatctatccatccatccatccatccatccatccatctatctatctatttttctacctatccaataaccttctcatccatttacttaccctaataaccatgtggctgagcaggggacactgttcctgccaactctggtgttcaagggtggctaaggaactcctcatctgccctaagcacaaatgaccccaagagttcctacagctggtttccacacacaggggctagtaccagctgcctgtgggagctgagggcagaaaaactgagatgagaagcttcaaagcttcttgaagagttgttccaaagagtgaacctcactcacacaactaatcccagatggttctgaaacaccccagggacagaggtggtgttgcccatctgagggaaggactgtggctgtggggttttttgaagaaagaggggtggtattggaatcacaatatccaagttttttgaagaccactttggttcctgggatgagagggcttctcttacttctggaaaagggagcaggacttcacacttcttggccaaggtcccaggcccaaccctcaactatgcagccagatgaaccaccaggtagcttaaccatctcagctcctacttccctctttatcattctgaaatgttatgatgagctcttgcatggtgcacacttttctttccttttacttttaacctacctgtgtctttatatttatagtccaggccctgtagatagctttcaattgagtcttgcttttttctttgcatctaatctgacaatctctaccttttgattgaaatttcaactccatttatacttagtgtaattgtcaatatggttgattttaaatcctaccatcttttgaattaatttctattttatcctacctgttctctgttcctatttccctctttccacccacacccacagttccctaagtaactacaggcctttgcctgtgctggttcctctatgtgcaacaccccctccatccttgactcaattcaaatgtcatctcttctgagaagacttctcttttcaccccagaatgggtccaggaccccctccacatccctgaacttatgctaaaggaccctgggtaattaatacattgttgtgtcagggtggattggttcatctgctcccctcttgcaccatgagcacccagagagccaggaatgtgttttgtctacctttgaggcagcacatgaagtgcttaacaagcatttgctgaacacataaagttgcagaataacatatgcagaggagtctattcaggcagaggtgacaaagagaaccaaagatgacttcagtgtcctggacccacaccaccctagcgcaggccttacctagagtcagtgcataataattatttaacttttattacgattattattggcgctaagaaaatgctgcttgaacaaatgaatgaatgaagaaacaactggagaagctgaagctggatgcgtcaggctccaggacctgctctgacaaaaccaggggcctttcccacagtgtttcagaagacctgggggattcgctgtgtcctgagtacaggccacagcctggggcccagacacaggcactctgcatggaaaggccctgggaagagctaggtaagtcgggggcagggtggagagaaagacagggctggggagtccagccttgccacagacaaaggaagacgtctaggccacaaggagactacagggcctgaggtcttctcaggagatgcagcccagagtacacatctcaggtcaactccagggccatggtcgtggagatgaaccacctcgggtgtctccagcatcaaaaccatcccttctgtctcacatgtgcccccacctactctgcttggcaaagtgcaagagcctttggtggttgaatgaatgaacgaatgaatggaatgagtgaattaatgaatgaagcacatcccaggaagggaagcttcatcacaaggaagcccatgggaggcctgctggatgaggaccgcccaggcctataggtgggtgggtgggaggatggggttggtaccaaccagcagcaatggctgcgggcagatgaccacgtcccccctccaaggatggcgatttgcttgggtgcaagtctctagaggctgcagccatggctggtccagaggcatgcagggaacagtccatgatcacagtgacttggttgatcttctcaggggcaggtgaataaagggagctcactgtgcttggaaaatacatccccaggggcttgggcaggaaaacaggctgccctcaaatgcctctctgccaccccttggtaataggaagaacactgcccaataactgagcccctcctggtggggcactgggcttcatagggttcagagggttcccaagggaagggccgggagaagggctgacccctcacatacacacaagacacacacacagatgtgcaagcacacgtatgcattcacatgctcactttcaccccaactcaccagcaacacacaagaccttcacagacacacccgcaacccctacacacagcaacctgtaacacagatacatatgtgcaacccccagagaagcagggccatccacatgggtgaacaaggccacacagatgggcatgttcacactcatccagagaccctgccttcagctcactcaccacaaccccagtacacacaccggtactcccaaatacgcccacagacatgcatgcagcttctgacacaagtatacacacagacccatccccacacgtaccacacaccctcatgtacacacatgtagactcataagtgctcacatgtgcactcacacataggcacatacacacacaggctcaccagcccccaaaccctccaagcatggctggactccagtcctcaccccaacatctattcctagtctatccccactctcaacccccctggagaccccctcctcctgcagcttcagcccccactaggagatataattacagaaagacagaacttggcactcaaagcacctcccctgccataagccccttccctggggcccagcccaggagaactagagctgagttccagggcctgtggccagggctgcctcccccaacacagccctgagcaactgcagaggggggccccgggcaggaagaaaacacacttgagaatggcaaagacaggagagggagggcagggaagaaatggccaggcccttcaagacaggaaggagagaaggaaaagccagccagagctgttatatttccatgatcgtgagcactgccaatgttcactgagcacttgccatgtgtgggcagcatttatgctaaatactcacaaaccctctgcaagctccaccctagggatggggtaagtggagtttcaagaggctgcatcacttggtcagagcctcttgctggtgagtaggagaactggaattcgatgcccactgtctgagctgccattctcagctccatgtcccagatctcctgccaggcctggtctaggtgacagaaagctagtgggatctggataggccctctaaccttgatatctgtttacttggctgtaaaatgggtatgagaacacctggcctgtcccacctagcagagaaaggcaccgtggggatctgcaggatcaatggatggccagggtctgcccgtgctggtctcgagttggggtgatgttgtcattacccataaacagagggggaggtggaacttcaatgcttcatgctccagccgacagcagcctcagccccacaggaacccagtcctctgagagctggttgctatggatacactcccgagggtcccagcctgccagcccccaagcccctgtgaaacccccagagtctgttcttacatgagtgggtcctcagggagggaaggggtgggctaactgacatctgggcccctgtccccaggtgtgcccacacagggggcaaggccccagagaatgccgccttgcctggggaggtacctgggctttgtttctgcaatggcccatctccccaggcctccaggcaggcagagccatgattttcagctcatccctgctcacacaaggcccaaaggcagggagaggaaggcctgggggcccccaggaaacacggtccccttgagtttcagtccctgcacagccgcgcacagctgtgcatccttgggtatatggcatcacctttctgagctggagcccctctttaccaaaacacaggccacagcaaggttcctggattgttgctacagagatgacctaaaagttggtgcccagcagagcaccactcacatagtaggggctttcacaaagtggtgcttgatgccggatgcagagcactccagggaggctcacacagcccaaggctttggaggctctagaaacagctccctggccatcagaaaacccagcaccatggtgggcagtgccagaaagggaggggtgatctgggttgaggggcacccaggagaagcgggcacagtgacccagcccagctgcactgccccacagcctgagcacagctgtgaccacccgggaccccaccccagctggcctttcccttcctgcagccaggatgtggtccagagctgctgggtggactgttggtcaagatcaggggctgtggtgcagatgctgcctgcctgggttcaagtctcctctcagctctcgaaagctgggggcttgaggcaagcaacctcattgtggtatgcctcagtttcctcatttacaacatgaaatattgtaaggattaaatagaaagtgcttggcaagtccttactcctcaatgagtgtggattgccattgtaaaagggaaaaatatcagcgacatttactatgtgcttggcacttaatttacacatttaatcctcagagcaaaacgctaaggtcagcatgagaaatagtcacaatggttcacaaatgatggggaacaggcagtgaccaatcagagcagataatggttaaaaaaccagagaggccccccagtttctccctagatgcagagatgtcagcccaggagagactctattactattccattactatcactattcattaccactgccactacctctggcttcgtagtggaacacagaggcccagagaggtcaaattaccgctgggtcctgggagaaggagattttaacccaggccacctgactccaaggccaaaacattccctgagagcacctatgcccccctagaaaggctgagggggacagagcggggcagcagaaaccagtgcccatgctcagcccctggagggggtcctcctggggccctgtttagaaccctggctcagacaaagggtcctgagagggtggggtactgctatagcccctaaaaggagctctccactccagacaggactttgaggagagactccaggccccagccagacatgcagctctgtttctttttcttcctttctttctttctttttttttttgagatggagtcttcctctgtcacccaggctagaatgcagtggtgtgatcttggctcactgcaacctctgcctcgtgggttcaagcaattctcctgcctcagcctcgtgagtatctgggactacaggtgtatgccactatgcccacctaaatttttgtatttttagtagagacggggtttcaccgtgttggccaggatggtctcaatctcctgacctcgtcatccacctgcctcagcctcccaaagtgctgggattacaggcgtgagccaccacacctggcttttttttttttttttttttaaggaacagggtcccactctgccacccaggctggaatgcaatggtgtgatcatagctaactgcagccttgatcttccaaactcaaaaagtgctgggactataggtgtcagccacagcacccggcctcgctattttcattcaagttgtcctctcttcaggaagatatccacggacgggtcccctggccctcttggctcccgtgggcctgtgtgtaacaccagaagtcaaggtcagcaggcactgaggccccttccgctgtggggtcctccctttactctctctggccctcttctctccccctctgccctcctcaccccctcaaaatcacagggtcccaggaaaaacaccctcagcaaacacccctgtgtcccagccggtgcctatggcagatggcccttccccaaatcctgcctccctgccaatggtgccagcagcggtccttgagggaaatatactcctgagatccgcctggcacctccttggtctggaaacagacaacacagactcaatgggaaccccacacctgtgctgtctgacacccaagggccacacagactccaggcccaccattggttgcccctcagcccctgtacccaaggcctgtgtgggcccatccatagcctagacttctccccagctcattgaaagccacttatcatgggcctgtggctccctctggtccacaagtcccaagtcagggtccatttctggttctccttggctcccaggcacctccaaacataatgggtgctttgatgaacagggaaaatttgatgaacgaatcaatcagtcattaacaataacagcaattgaaaccacatcaaagggccttccacataccagcaactgcactaactgaaatgatgccactggtgataagagtaccagctggtgatgacagccagcaccactgagccatgagtgctgggctctcggccccttgtgtgtgtgtgatctctatgaactgtcaaaagaatcctggatctaaggcccagagaagtcagtgacttgcctaaggagacccaataagcaaatgagtatgtcataccccagctcaacaacaaagacacaagccaccacccatggtgccctcactgtgcatcagccactgtgccaggcacattacctgtatgatgtcctcggcctcttacaacaattctctgaggttgggacaattattattcccattttatacattagcatttgacaaatgagacccagagagataaataacatgagcccatcacatggctggaaaggcaatggcagtgctgaggttcaaactcaaggagtctacagcacagcagttctgttttgccactgcgcgatagcgccgcttcttggaaacacggcactcagggtacgtggctcctgtggggaccagaggagccccaaggagaggagcagggagcaggatgaggtggactgcacttacccggggcactggcgatgtctgggtgcctttccggggcccactggtctccggcgtgaggtcacggtggtccacctgcatgtggctctccaggtcttcggcactctcaaacttgacactgcactcggggcaacggaggccggcacagggccggtcggcgggctcgggcggggccaggccacccacctgtccgttggcgctgcgggccatgcagccggcgcagaggccgtagggcagcccattgacgtcaagcttcaccaggtcctgcttgctgcggaactccttgaggcacagggcgcacttgtagagcttctgcagcccctggccattgggggaggacgccgctgagctgcccgccagcttctgcatgtggaaggtgccatggatcttgagctcaagcgtggaagtgactgtctgcatgcagaccacacagcggaagcccgtgagtgagttgcgcaggtcagggtgcatctggcagtgctcaataaactcctcctcgctctgcaggggcatcttgcagatgcgacaggtgcccgtgtccaggctcttgctgtgggtcaccttgtgttcggtgagcgtcagcagcgaagggaagcgctcaccacagatgggacacatgtagtgcttggcagggccccggtgcgtctgcaggtgctcccgtagcccgttctccgagaagaaagtccgtgaacaaacgttgcacttgtgactgcccttgataaactcagccttcttgcgtgagccatcatcctcgcccggccggatattgtggtcccgcagccggtgattctgcagcagcacctccatggtgtaggccgccccacagatgtcacagccgtacatgggctccgacgcgtccacgtcatcctcgctggcctcatggctgttaggtgcctcagggttcttaagcagcatgccctgcaggtcagcaggctcagctttcttggtggccattgggggtaccccattggccgtgccgttctcggtcgcagcatcaaacacacagtgcttctcccgcaggtgcttctccagcaggatgatggcgtggaaggccttgctgcagaacttacagttatacttcttgctgtgtgtggtgatgtggcactgcagctccacctcggtgctgaaggtctccccacagaagatgcacttgtgagccttggccgggttgcccaggtggctgtgtttgacgtgcacctgcaggtcagcctccttgcggaagtcccagttgcaggccgtgcagcggtacatcttcttctcattgctgtgcttcaccgccaggtgcacctggatggacaccttggagtcgaagacctcctgacacagggtgcagtggtacaacacaaaggtgtgcatgtccagcaggtgcttctgcaggtcatccaccgaggaaaattgcttgtcgcagctctcgcacacatagtgggtcgacgtggtcatgtaatgcactgtcaggtgctgcaggagggactcctgggagtcaaagtcctctttgcactgggggcacgcttgcttccgcagcagcagctccaggtgcagcttcaggtgggtctggaagctctcaaagttggagaacttgaggtcgcattgattgcaaggatactccccattggagatggagttggcgcttgctgagagccgctgccgcttcggggaagacacctccacatcggacgagactgggctctgctcggccttggacttcttgctgtgggccagtggaatgttcttgtggttctccttgatgtgcttggtgagtttcaggatggagccaaagatgggggagttggtgcagtaggggcaggaatagacctccatgaaggactgcgtgggctgcaccaccggagactctagtttggcactgcccacactgcagtgggcctgctggatgtgctcggtgagggaggactcagtaaggaaacccatggagcactggttgcagaagaaagcattattaccgtcagaggggttggcgttggggccgcagtgggagacgcggatgtgctcctgcaggctattgatgtcggcgaacatctcggggcagtagttgcagtggaaggcagagatgttgccaaactgcatcacagggtaggcatggttcttgtgcagcttgcgaacgtgctcgttgaggttgtagagggtgggcatggagtccaggcagatctgacatgtgtggctctgctggggcttgtccgcgtggatggtcttcaggtggatctccagcacggccaggctgttaaagtcccgcttggaacaataggggcagctatagaccaccttggtccagccctgcccgtcatcccgcatcttcttctgcccccgcagcggcttcaaggtggagtccggggtggagccacgctccacagaggcgctggagtcgggtgtggcgctgctcatggaggccacgctgcccagtacagggtcgggactgacactgtggttgctggagtcgggctgccggtggctgtccaggtggcagtagacaccttccactgaggagaactgctcagggcacatggggcacttgtgtttctggttggcgtgggcttggtggatatgggcgagcagtgtgttctcgtcgacgaagacctcagggcagtgaatgcactgcaggtccgccttctcggacagctgcgggtggcgggtgagcacgtgcttctccagctcctccgtctggctgaaggtgtcctcgcagtagtcgcacatgaagtcgtccttcttggcttccttctccgacttggccagatgctccttgttctttttgtgggcctgcatgtggctctgcagcgagctggtggaggagaagccgcgcttgcacacagtgcacttgaagggcttgctggagctgtgggtcttcaggtggatcttgaggtggtcgctgcgggagaaggctgcctcgcactcgtggcagtgatacttcttgtcgcccgtatgcagcttgatgtgccggtcacggctcctcttgtgcttgaagaggcggctgcagtaggtgcacttgaacggcagcttgtcgctgtggatctgctcgtgcctcttcaagtagctcaagcggatgaaggacttgtcgcagaactggcaagggtatggcaggcccgtgcccccttcctcctcgccgaggccgaggtcacaaccatctccgatcatctgcgtgggtgacgcaacatccttgctggagggagacgaggccacccaggagagttgtgggtcgtcatcaccatctgcaagagaaggcagagaggatattagaggcaattcccagggctgccgagaaacaaggacagagccagcttctcgacagcacgcgggctgaggctgtgcagctggccaacggctgcagggggctgtggggaggggcaggggccggaagcaagtggacaccagggccttcctgtctgcagagggcacgccagaggggcggcagataatgaagggggagcgccttttcccttcacaacacttgcctggacctggcaggacatgataccccccatcagaggggaggctctcggccactttcctgatagggaaaggaggggcagcctggacaaagtcactggaaacgaactcacagaccaccagtcccataggccaaaaggaagacaagtcctgtcacttgatccacacctgggagtcaactcccctcaaatccctaatcctggagggaaggaaatcccactggtccttatgaacacaggcaaaattttgcaacaacaaaaatgcccttatcagattggccatagaatgcaccattctctgggtatgggtggactgatggagctggaagctgctgcttcaggtggtagacaagacataggaggtgtgaaatcacagggcaagagacagcagacttcagtgctcaggtgggaagggaacctagggcactgaagaggcatctgtgggtttcctggcccaggccatcctgagacccttgttttctttgttcccactgcacccctggatttgccccaaccccacccaggatcaagacagatggagagatggtgacagtgattggaggatgaatgaggacatggaaggccacagagctcagacccaggcggacccttaaccccactgcaaaggcaaggaagagacaatccttgtacagactccagccagtcccaccctccctggggacagcccccacaacccccctcgtttgctggcccggctagcctcagaggaaaactaaacaaacctaagggtaggccgtttctgggaaaacaaaggcacacaggacacagtgaataaagctagagacattccccggcgggggccgagcagagccagcccgggcagggagtgagttccaaggctcaagtttctcttcggctggatttaaaacttaataatgaatgaaacagaccgcaggctgctgcgggcaggggagagacaaacaaaagctcagattcggctccgctgaccttgctcttgtaaccccgaggaaataaaccactgcccccgcctctccagccgccagccagcctggctgagtcttcagaagagcctcacagacgtaacccagacgtaaccttggcccagaggcagcccagaccttcaggaagggatggggcaggcgcaccatgctcccagcacgggtgaacactggcacacagatgcgcatacacacgcctacctacatacacacacaacacccaccatcacacacattcattcacaccatcactcccacacactcacactatcactcacaaacttaaatatacatgcacacgctcatgtacacacattcacctgcagacacacacacacacacatcacagacctgtggtttccctacaaggctctccacacaagctgcctctgctgtcccaggccgatcctaagacttaaagagagaacaaaggctgattggggggtcttgaggggtccctcacagctggggctgagcctggtcctaggccccgcccccaccccctggcccccgcagcgctgattgtgtgaagatccacctgacccccctggcaccattggcacagctcaaccgggatgcatgcggctctccgaagctcgcagttctccaaagctcccgactgcaaggcttccggcagccaacccacctctgaagcccagctccccagcccagctcaaggggcctcctggaacaccctcccagagcaccagcaccttctcccccgggggcctcacatgacgggctcggcagacgggaaggatgcagcagtcgtggccagctccccagatgagatgcagtgggaggcgccccagcccctgcctgccaattcccagctcttgccagctgggctctctggggcacagacaaaagggaccccagggaggagatggctggggccaggggacctactcggcccccgctccaggccaggctggactggcttcttattattttgatgtcttcactcagactcactcaaactgccactgagcccttcctgtgtgcccagcactcagtgctaagtgctttctcacaactgcaaatgagtggccaggtccactcccactggacagacgaggaaactgaggcacggcctcagagacttgctctgggaaatgacagtgccagagactgatgccaggactgtccacattcaggccccttgatcgtgatgtgggcctggaccagcttctgggggccaaacagtcaaataagaccactcctgcgtgggtaagaaggggagaggcccacgtgtaaagcctccagggtcctcaggacttgatctccttggagcctgccttgtgaagagggctggggctggcccatgatttgcatttctgggaggggctcatcagggttcagagagacacaggaactggctggaacccacccagcaactgatgtgtggagaagtctcaacaactgggcaggtgaaaccactatcactcttgtccctaggacaagcctgaacagatatttctgccagggttcatttgctcctaaacctttcacaccacctgaagaccagaagacactcactcagagccagagccctcccagctcctctatgaattcatccatgccctgaacattcctcttaaccactcactttacgcatctgaaaaaagggaatcactgggaggagtggatgagaaaaactaatgggagaaagcactattatgccactgacatgagatgtccagaataaggcgcatctgagacagaaggcaggttagcagctgtccgaggctggagatgggagcagggactggctgcacaggtgacagggatccttctgacatgagggaaatggtctaaaactagactgtgggtgaagactgcacagctctgtaaacttaccaaagactggctgagttgctcacttcaaacaagtgaattttatggtatgcaaattatacttcaataaagttgttaaacaaaagcactattttgccaataataagaattagtactaattagtgccacaagtgctaacaatattaacagctccatttattgagaatgtcccacgtgccagcactgtgctaagtatgtctattatcgcaattaatttctattcatcctcacaacaaccatatctggctgtctgcagtaacattcccatttctgagatgaggaagtggggttcagggaggtgaggaactggcccccagtaccaagccagatgccccatttagtgtctggccaaacttcatcctgtaggagtacagaacctggtcccgaggccccacatcagtcattcacccagtaggctttgaaaaggagaatcttaacctgcccggcaccagagtacccaaggttcattgcaggctggctgcttggctttatttttctgcaaacaagttttgaaactaaagcaaagcgtattattctgggagcaacaagctgagccactgctgagattataatcatctgaattgaaatgaaaataaggctccttaaactgaaaaggcccaatcagggaaaatgggcatgttgacatataaagtcccaaactcagattgccctgtttaaagtcttttattcaaagaacattcaacctcgcctgctgccatcccaccccctccaaatgcattttgctttggggggacttagctcagtgctctagaaacaggctagagagataagctagggccaaagctcgggatgtatctacaggggcgtcagcagagaaagcggttctcttttctttttttttttttttttttttttggcaggggcaggaggggaaggagtctcgccctgtggcccaggccagagtgcagtggtgtgatctcggctcactgcaacctctgcctcccaggttcaagcaattctccttcctcatcctctcatgtagctgggattacaggcacatgtcaccatgcccggctaatttttgtatttttagtagagacagggtttcaccatgttggccaggctggtctcgaactcctgacctcaagtgatccacccgcctcagcctcccaaagtgctgggattacaggtgtgagtcactgcgcctggcccaaggttctcctctcttatagcaatgacactttcctcatgctggatgctggacaccacacacacacctgcaactgtggccaaggcaatcccaaagtcccctccaacatgaacattccagaattcaggaagaaggtgggttcaaggaaagtcctgttcagtcgctacatttttattttcaagtaaatacttgcatcgattttgctgtgtgccaggcattcttctaagagttaatgtgtactcactcattcaatcctctcaataggctaatgagttagggactgttataatttccatttacagatgagaaaaccagggcacagagcgactgagtgacttgcccagtgccacacagccagcaggcagcagagtcaggatgtgaacccccccttagtcctgttcagtcagtgttttcacccacaaggcttcactaccccccaccccccactttgggaggagaagcatgagaaaatcaagtgggaagtacaatgactaatgacagacccatgcttcccctgccccccagagtaaatgcaatcaaagaactataacaaaaatgagttaaaaaaacacacacacacttgcaaaatggagattaaagtcatttaaaaatgactaatcctgcaaaaaggccaaataggaaatgggttatatgaggcttttgctgtctgctgcaggaagagaaagaaaacaagcataaaagaggagagaatttttgataaaaattcaattaagttgaaaaaagaacattaactgggcttcagaacacgtcagcagcagaaagagccaggtgattcccaagctcatgtggtcacacttggtgaccagcatggagcaggacatgaattcagcaggctgatgctacagtgtgtaaaactgcctcggacacacctcatctaggctgagcagtgcaagtggccgcccagaatggctgggagccacagctcacggctcctctgtcacagagaatcaaggtcagagatgctggagaaggtgctcgggccaaggcaggagagtgactggcccacagactcacaggagtgggccgaaagggaaccttcctgcagtggggggcacacatggaagaggaagtgaactcctgccatcgaagctatgcaagaggccctaaaaagaacactagggggactctctgcattgagtttggggggaagatagctgagcccaggaagttccaggttactaggacattcctgagctgggcagttccatctgtgtgaataaaaatgaccatccagccgggcatggtggctcatgcctgtaatccctgaacattgggtggctgaggtgggaggatcgtttgaggtcaggagtttgagaccagtctgagcaatatagcaagaccctgtctcttaaaaaaaaaaaaaagaacaaaatttacacaggcatggtgatgtgtatttgcaaccccagccacttgggaggccgaggcaggaggatcacctgagcccatgagtttgaggccgcagtgagctatgatcatgccactctagcctgggtaacaagagtaaaactctgactcaaaaaaaaaaaaaaaaaaaaaaaaaaaaaaaaaaaaaaaccgtgagcctacagagggaacaagagctcatccagccattggaataaggtttccatcccagtcctcagggcctcttgtgcccaggactgtgctgaatactgcagggtcgcctgggtgcatcccaccttggtcctgccccaaggacattccagaccatgcaaaggagaggccaagtagagcaagaaaggcaccagtgggagtcatgctggggcaacgggcagagagtccatcaggaggctgggcctccactgcctctgctggctcatgggaagctggaattcatgctctctatagcccctgccatatgaatataaagatcaccttgtacaatactccaaccatcaagaccatcttcatgatagacacaaaatggccttacagtgcttcacaaagtccccaaaaagactccttgccactcaactgtttcttcagaaaaatgaaaattgccaaggagaccagttcccgacaggacaaagctttgtaatacaccaagcagagcttctctgctgcccccatacagagctccaagaataggaatcactgtggcccttccctaagctcagaggaatgggaccctagactcaggaaccaactacccaatcccacatgatacagatggaaaagctgaggcccagaaaagagaagaaaacttacaagcccagctaattggtagtggttgcctagaatcctgtgttcagaaggattccaaggccttatctcaggtccaaagaaatgagtgctgcaatcaactgatgatgtctgccatgagcagagacatgtaggaatggaatagtcaaagggcactgagcaaactggaaagaggagtctcctgactcccaatgctagatgcttttcaggtttcctcttccaaaaaaggagctgtccattctctttgagagatgaggctttggtgttcccaaaatcctgttggtcacagagagacaagaggccctgacagataccgtatgatatggtttggctgtgtcctcacccaaatctcatcttgaattgtagttcccataatccccacttgtggtgggagggacctggtgggaggtaactgaatcatgggggtggtttcccccatgctattctagcgatagtgagtaagttctcatgagatctgatggttgtattaaggggcttccctctttgctcagctctcattcttctccttcctgccaccatgtgaagaaggacatgtttgtttccccttccaacatgattgttagtttcctgaggccttcccagccatgcacaactgtgagtcaattaaacctctttccttcataaattacccagtcttgggtatttattcacagcagcatgagaatgaactaatatactgtagaactgtgttggagtctggagaggaatctccagccagataggtcagctgtgacatcagctgatggtgaggattgcccaaagtggacacaaagcagcccggacaaccgaggagagccagtcagtgtttcctagagcctggggtaataagagctgcaagacctgaatatgcttcagggcacactgtagattgtggttcccacagaggtagccagagcctaagcaggtggctttccagacacgaaatgatccaaattgagctcaaggggcatctgggcatattcctgatcacttcttgggaaaccaggggtacttgcacacacctgatgccagaactagccatccatcccagaatactcctcaactcaattacatccctgcctgtaaaactagcatcagtgtattgagggcaagagagggtgcatagctcctccctcatcttatttcactgatggagaaactgaggcaacatgacaagtcacaggcagatccagtggttactgtttatggcacattttcttttctttttcttttttttttttttgagaaggagtctcgctctgtcacccaggctggagtgcagtggcacgatcttggcttcctgccacctctgcctcctgggttcaagcaattctctgcctcggtaggaatcctgagtagctgggattacaggcacccaccaccacacccggctaatatttgtatttttagtagagacaaggtttcaccatcttagtcaggctggtcttgaactcctgaccttgcgatccacctgccttggcctcccaaagtgctgggatcacaggcgtgagccaccacgcccagctgtatgacacattttctatgtgccaggtcctttgccagctttttctcaattgattctcacacattccctatgaggtaggtactattaacaacccctttttataactgtgcaaagtgacactccaagaaggaaagtaacttctgagcgcacagacattgcaagtggcagatgcccccacccacttactaaccaccaggctacactgcttcaccaggccctggagccagtccaaggcccatatccctgctggacctgctccctctttcttgaggtccaccatgcacaagcacagtaccaggccccgtgacttgaaccaggtacaggtcttaagctttacaaccccacctgccattgaggcaaagtcagtggtggatgaccaggctaggctgggtctgatgccaagcactaatgaatgttgctggcctctttcctcactggatggcaggtaaagtagcctgctgcttaaatagcctatgcagaagcaaacctggagattgtggtaggcagaataataattaccccaaagatgtccaagtcttaacttccaaaacatatgaatatgttacgttacatggtaaaatggaattaaggttgacaattggctgaccttaaaataaagagattatcctggattatccacatgggtctgttgtaatcacaagggtccttaaatgtgcaggagggaggcagaagaggaggttgaggtgatgcaatatgagaaggacccaaccagcaattactagtattgaagatggaaggaggccatatgccaagaaatgtgagcagcctctaagaactggaaaggcaaggaaatggatttttccctaagagcatccagaaaggaatgcggccctgccaacaccttaattttaacccagtgacatctgggtcagacttctgacctacagaactctaagatactattttttgtttgttgttttaagccactgtgcttatggtaatttgttacagcagtaatagcaaactaatacagattttggtaccaggagtggggtgctatgagaacaaatacctaaaatcatggaagtggctctggaattgggcagcgatcagagggtagaagaattttgaggagtatgatttatttaaaagcctaggtaaccttgaacagattaatggaaacatagatattaatgactctgttaataaagactcagaagaaagtaaggaacacatcagagaaaacctaaatcactttaggaaatatctaaatcatcatgaacagactattaagagaaatatggatattaataaaggcactgacagtgaaactgaaggaagggggatccttgatacttggtggcagaaagctaagtgaaattatgactcacagttatgtgggaagcagaactttcatggataaacttggatacttagctaagtagatttccaagcaaactgtggaaggtatgggctggtttcttcttgctgctaaaaagaaaaaagattaagaaaagaactgttaagcaggccaggcgcagtgctcacgcctgtaatcccagcactttgggaggctgaggcaggcggatcacctgaggtcgggagttcgagaccagcctgaccaacatggagaaaccccgtctctactaaaaatacaaaaattagctgggcatggtggcacatgcctgtaattccaggtactcccagctattcaggaggctgaggcaggagaatcgcttgaacccagaaggtggaggttgtggtgagccaagatcatgccactgcactccagcctgggtgacagagcaagactccatctcaaaaaaaaaagaaaaaagaaaaaaaaaactctaagagatttacttacaagaaagcatgctccggagaaaaagctgaaggtaggactgcacatattgctaatatctcaggaaaatcaaaatgccagagtattgagtattcagtcacaacaaaggctctttggtgagattaagggtgtgactcacagatctcctagatcaaattagagagcatctaggaaatttgggggtattgctctggagcaatctcagcaaaagacaaaagtagagaagggattatccaggaaatatctgtagaggaccatcttgaataatggagaaaatacccatgacatacacaggagactcacaaggttcttgaaaagtttatactgacagaaacactgccagcttaaaccaaaaaggacagagagagtacaggatgaaagaagtctgttggacacccaaaacttcacaagcaggaaacaggttaataaaactactcagatgaaagtacatgctacctttcatggggaaaaaagggatgactaagcgggcagaacctcaagcccagagggtggagccatgagccatagtggatgagatcactactggaccaggttcagattccagaactgtgtaaccatgggcaagcatatcccctctttgtgctttcatttccccatctcttgatagagagaatccgacgaacaggtctctaagaggctttgtagctcttacagtctgttatcacttaatgatgtctgtgcctgccctgggtacagagtaagtctcaggtggtaggtatcccagctctctactatctcctagttcgggtggttttttaattcagcacatatttaggatgcctgctctaaatatccagttttccaaagggtgtagaggtacccagcattcttaggtttctatgctcttatctgtccaatctccgtgtcaattaattactgtttaaacattaaacactaaagaaaccctttactgctttgaagtacacacacacacacacacacacacacacacagggagagagagagagagagagagaatcccttcaattgtaacatcagtactgcacctagatatctgacaggagaagtgtaaaggattaagtttgacccctgggacatcaaaagtccaccctgggaaaggaaagggatgaggctattggaggttctttcctcagaggtaagccaaggagctccacaaaggtgaccagaagctgacatggctcttcctgaaatctcgagttagaattatgctattagcaaaaataatagcagcacctattcactcattcctcctccagggagctgagagtttcttacgaatgggatctcatcatccccaaagtataagcaaggaaaagtagggatcattccttcggtttgggagaaaaaagactcagaggtcactggacatctcaaagacagagactgaccaggcctgcccttctccagccagctctgggggctgctgaaatgccatgtgacagtgaacagctgccaccaaggcccttaacaaaacttccagggactcaaaacttagcttaggctgctaagcttgaagaaactcagtcaattgcagggagacgtcagccctgagggacagcagagccatgagtaagagtgtgcactggcttgctcagccatcattagctgtgagaccatgggaaaattactgcccctctctgagtgcccatgtcctggggaaactaaaagtaactaccttacaaagtggttaatgtttacatactgctaaacattggatgaacattggctaaataagataaaggggttcctaatgtaactgacactattatcattcatcgtaaatcccataatctacagggcatttaacattttgcgcagcacctcacacccattatccatttgacatctggagcaactctgtgcagtggtggtggtcatggtggttttgttattgttattatccccatattacgagtaagtggggggccacacacccaggcatcctgggatggaacccagcatcccattcagttagtgaatccctctcaccctcataaacagctgagcttacacagtaagttgtgtggtcaccccagtaatgaggaaaaagaacagagaggttaggtcacatcctgacatcacaaagtgactggaagagctaggcctgaacttccaacccagggctcttagccagctggactgggagaaatgatgccctgagcaatgggtcataggtcatcatggctgtcctcccactggacagtctgggggccacccagttatcagtattagtgattttgtgaaaatgccaacatttacaaatcaagaattcccaactttttgttgttgttgttccttaattcacagtcacttttggctttttttttttcttttttcttagagacagggtctccctctgtcacctaggctgtagtgcagtgatgcaatcatggctcactgcagactcaacctcctgggctcaagcgatcctcctgcctcagcttcccaagtagctgggaccacaggtgcgtgccaccatgcctggctaattttaatttttttttttttgtagagacagggtctctctatgttgcacaggctggtctcaaactcctggcctcaagggatcctcctgcctcagcctcccaaagcactgggattacagtcataagccaccacgcctggcccacttacggtttttcttgaaggagaagaaggcctgggagcacagactctgcatctggcatgtggaagatggagctcagctggggcttcttggaggagggacccccacccccctgcatgcccagcaccccaggacttccctcaccattagggggtgtcccgggccttggagacatctgtgtttgcctggtggctgagagccggcagcagggcttagactcccagctcccccacttactatgtgtgtgaccttagccaagtgaatgacccttgctcaattttacagatggagaaacctgtctcagttttcacatctgtaaaatggggatgactatttatagacccaactatagagttgttttaaagatgaaatcagtgaatatctgtaaggcgttatatatgacaaatgttctataatgcctaaaatagtcactggctactggctcccaaatcaccataaggtggtcacaggacaaggagaggctggcaatggctggaatggtttgaggggacacaagacacagtgtcacctccctgagccctgattgataaccaacagggtctaagctaaacctacagttacccgtgcacaagatggttttcaaacaaagcaaactcaacctgccaaaattctcagagggcccctgccatttacaatcccaggacatcagccctgaaaggagcttcaagacccctcattatacagatggagcccaacgctctcattacacaaacagagaatctaaggtactgggagccatccatggcttggatgtgggtccctcagctcatggtggagggggtgggggatgaggctcagactcccagaacactccctcccccgcccccacatggctgctggacatgcagggcaaggacgcgtccacctttccccttgaagcctctgacctcgcagaacacacagcctgccaggcagctccatcccttagacaaatttacttagcactgatattgaaaatgcaattgagctcgagttttattgcagaaattaaacagactaggaaaggggaaaaaaaaaaagccagtgctcatcagctcacccgagagctggctgtgatcaaacttgctaaagaggagcctagtgatcaactcctgccagcaaggaagagccccccaagtctgcccctacaagggactccccaggggcacgaggagctcaggagctccggaaggttctcctgccagcctcctggcgtggacctcctgcgcaccctgacatcgcctgcccgcctcttcacaaggagttggcgccttgtgaagtcatctccgtgagcttcatgaagcaacaccgccaagggcctgagcaaagggcgctctgctccactcgagtgaaagcaaaatgctttcggggttgaatcactgtttttcttgactccctttggagatcggcagagcccacattcggccgtgttcgtggacctgggactggaaacagctgcgctctaattacatgtaaagtgtaccaaaacatcccttttatcacagactggaaatctgttagcatctgcctctcctttgtttcttccacaagatacaagcttgtttctacatttttctcacctgtagcagtgattaaaattcattataaatgaaaggagtgaacagagaaacaagttcctctgtgtaccgttctaaactcaaattagaaacagctgtttgctaattcatgcagtgatgttttgtcgtgctctgtgaatcaataataactcaccctattgctgcagaaatttttggataatccacatatttaacgcggcattggattctccaggcagggctgcagcggcaaaacctcaggcgggtgggaggggacttggggtccccactctggaggcgtcccctgctgcccagacagagaacccctaactcagagctgcccagcacctctacccactacacaagtcttgggaggacctgaaggaaaccctgaacaggcgcctcatctccttccctccccaagaaccaccaaaaaaaaaaaaaaaaaaaagaattcaactctgattaaacgcaaaccacacacatcctccagccgccggagggaacagcaaaattaaaagtctaattggtacccggaacaatttaaaactattaagtataggtgaagcttttctgtaagaaaataatcctctgattgggattaggcatgtttggatagcatttttcccatccacacattttagctgcagaagttacagctaaggtctggacatgctcaggagcctctgagaagtgttcagtcatcccctttgccacctccagggaaaggggtgggtggggtgcagagctgcatccccatctgatggcttagagggaagcagatgctctctctcctttgcagggagggagatggacaacacttttggaggcttgtactgccactgtggcatgccaaacctactctatcctggctaacacatgcccatccttcaagacactgcctcccggaagccttccctgactgcctctgtcatcctccctgacttcagggcactacctgtttatatttgagtggttggggtgtccctgtgtctcctgcatctttctaggtctggggcattgtcatagtgaaccactttttgaacttcagactggtagcctctgcagagccctttctgtggccagacacagtgccaagctcttcgtaagctccattttgttaaactctcacctgcatcctatgtggtgaccactaccaccattaacccccatcttacagatcagacatctgagacatagagagggcgagggccctgacttccacagcaattaagtagaaggagcttggaatgactccatagatctccagaaagccatcaagaccacccactgtcatcaaagatgtataccgagcatgcctcacctgctccagctcctgagccttcattcaggccatggtggtcactgcccccgaaagcccaacccatgacttgggggccagctctgcccacctccccaagcatctcacaggtggtggtgggaagggtggtctcctgcatggctaagagtaggtcctcatttcctcctttcctggtgttcatctgggcctacagaagatggcagtccaatacgtcctggggggcgtagagcacaggccccaggcaggggcatggacaaggagctcatgctgtccctgcagggttgtagggagctttcccttagccaaggccactgggtgccagaagctccaagcccgggagggctgggaatggaaatgcacagatgaggtgccatcatgggaggcaggagcactcaaattgggctttgaagaaggagtaggagctccactgatctgtgttcttccaaacatgggctacctcccattggtaggacccgtgatcattttagggcgcagccaagatggtcttaaataaccctgatgcacaaatgagaaagttagcgccctttccattctgttgtcagccttcagattaggccagggagaaaggctgtctctaactcctctccagcatttcagcaaaagagagggcagagtccacgcttagcatttccagaacacagcagctcatgtctggaatagtgtgagcatggaattttcttcggttttgttttttatttacttttaaggttactgtcatcttacagtaaatgatactggttttccatttgcagaattaagtaaattaattaatttaaccacaaaagagccagcaaagacaaatactaggtgaatcatagcatcagtgatactcaaatgttgcaagaatcacagtagagatatgcaaatgactaaagcctgggacctccagatacagagagatgggaggagaaggcctcctgggagaagcaatggcgggagccatggctgaagcttgggtatcagtgggagaagcagcttagaaggtgcaatgagagcccatcgtcaagaccttaaataccaagccaaggagccaagaactccattccacaggccctggcaaccaccaacactatctgaaacactagctcatgagtaagtgggatctggactccccagcccagggctctttctagacctcccataactccaggtctgcgaatgactgagagttaaacaatcactagcctataagcagaacccatttcaaggaaaacagtgatcagtgaccccaacgacccagggctctcaacagccaagatcaggtgcccctgcaggagaaaacccctgcacaatcagcatggggtccccttccacgtgggggctgaacactcaagtcactgtggacagcagaagtatcaactcccctcacaaggatccctgctggggcactgagggggatgggcgcaccacctttcagtgagtccaacccagccagcttttcctccacttttggaataaattgccatgtcctctgtgtgaaagagccaaggtgttcccaaatacacaccatggacctcaacatgctgaacaggtgtctgctcccacaggaggggagtgtggaagccgaaagcccagaacagcatccatctcacggtcacttcgcccctgaacccacaccactgaattatttttcttccacaaacccacgcagtcattcccttgcagagcacatacaattgaagcactgaatgctaagtgggtgcacgaggtaactccagtggggttttgttcatcgggtccagggcaagtctccaactctccaagtgtctgtcccacctccctctctcctcccacccccaccctggctacctagggacccgagtcaaaggtcttctgacttccagtcctccatcccatctacactgcaaatccttctgacagtggtgccccacgttggggcagtgtaggtgagacggaggactgaatgcagctggtttatgtgactttcttaccagagatgcagacagaggaagctctcaatgcgaataaagaatgggcaagcggaggccaggtgcagtggctcgtgcctgtaatcccacacactttgggaggctgaggcgggtggatcacctgaggtcaggagttcaagaccagcctggccaacatggtgaaaccccgtctctactaaaattataaaaattagccaggtgtggtggtgcacgcctgtaaccccaattactcgggaggctaaggcaagaggattgcttgaacccagggggcagaggttgcagtgagccaagactgtaccactgcatccagcctggatgacagagcaagactctgtcttaaaaaaaaaagaaaaaaaaaggcaagtgggtaaatggatgaccaagttcatcttataattttcccaaaagccagtatcagagaaaaccccataatgcctccaagctagaactctgagcttagaccaactggcgacactgaagaataattaatagattatactttgtattctatatcatacattgcatatgtacgtataggtctaatcaatgatgtttattaagtgccacatatttcttgggtgtttgatccatgtcacgtgttgtctcattttattttttgtctccaagaaaaaaaatgagttgtctcattttaatattcacagcaatctgatgtgttcctattaccagccccattttatagatgagaaaactgaggcttataaaggttaattgacaggctcagggccttacaggtggagatggcctagcagggctttgaacatggattccctgacctcagaggctgtgttcctaaccaccgcgggatatgagtttatgaaccaccatgtcccagggaaagagagggagtgacacccgttcaggggcacaagcattctgccaaggaggtggcctcccgtggagcccagcctgacaggatgtctggattgggtccgtattctcagcctggacacctctcagggtgacacgctcctttggctggagacttccacagacaagcggcacacactgtgtgacctcaaatcacagatcccctgcttctcagtcaaatcccatccaggacctagccccagggtcccaccccaagtatctggaggatggagaaactccccaaaaacactccctgtctccagccatgtgccaggtgccctccagcagctccaggagacagtcatgagcttggtccaattttatggaagggaacgctgagggacagaggaactcagggacctgatgtgtgcatcatggccagtggccccctgggaattcagcagctgcagggacagtctgagtaaaagagcctgaggccccacctccaggtgtctgcctgtctcaagtctgaccccaaagggaggggaggtgatgcccccaggggcaaccttcacctaaaagggcctggagccagtgggctcctctgaagaccattcctggggcaccctgcagacacgaaggttttggcagtttcaagcccagtggtctacagcagcaggctcaacactgcaccccaaaatcggcctttccctggccctgtctcctccgtcctacttcctgggagtgcctcctcgccacatatgtgcactaagtccttgcttcaggctctgtgttcaggggtcctccctgcaacactgactaaggtacaactgccacagatggtggtgtcagacttggaagccatgtctttcagcctgcatagcctcctccacagcccctaatctgcacctgccaggatttgccatgctcaagtcactgagaggccaccgtcagggtctgtgtcctatactattactcaaccttgtcctttcaacgacctcaggactaacaatgtcaggtacccaagtgtaatcctaaatcatgatattgatgaaatcatgagtatgatgtttttgtaatgcccattaaaataaagatgtaattgggttaaacatgcatgaaccaccagaaactgggctgggcagccctagatgtggcgcaagtcctgctgccctggcccatactgcagtgactgcagctcttggtctgtccctctccccctccagacagggcagtgcagggacgagggcgcaccttcatagctgctgtgtccccagcaccgtgcctggccagaggcaggcaggagagaagaggtgggctgggcgctgcaaggagcccggggcctgaggagggccaggaagagaagagccagagcattttcaaggatgtgctgggctagccaggcggcccctctgagggccccactcacccctaaactcatccaaatctacaacacgacagaggaaattccaattttcccgattttcatgtttccacccctagagtaattgtcgtcgtggactttgtagctgggctgttgagcctcatggctgaaggctgccccagccctgcccgtgatgggcaggagatgaaaacgactcatcaggcctggggaaggctctgggatatggcagcagcagcagagaggcagccacctggccctggaccaccacgaggaggaggagttccagtttgtttggccagcacgtcaggtccctgaaggcagctgtggcagggcattcccctgactggattccggagtgtggggcagggcccctgaagtcctaggcatcaaggctggggcatgtgggtcccccaccctttcccagcatcgctgactctttccttggaacccccgccccagcaccctgcctgtccctgctttctcagcccgagtggccaccacctcctcccactggaaccaggccctcatctgtgtgcctcattatgtgctcctgctcacaaacagacctgaatatcagccacactcaccagacacttcctacgtgccgggctttcttaaaatctatattatttatttactcactcatattagtctttgatgttttacttgttttagcggggggtggtttgggtttttaaatttgaaatagagtcccactctgtcgcccaggctgcagtgcagtggcgcaatcatagctcactgtggcctcaacctcctaggctcatgtgatcctcccacctcagcctcccaagtagctgggactacaggtgtgccaccactcctggctaattttttatatttttttgtagaaatgaggactcgctatgtatgttgccaggctgatctcaaactcctgggctaaaccaatcctcctgcctcagcctgccaaagtgtcagaattgcaggcgtgagccactgtgctcggccgttttactatttaatgcatttaagccacacataatcctttcactagaccccccattttacgatgtattgtgcattgtacacatcgggatactgaggcccttgaggtctgagggagggacttgccccagggcagagtccggcagagccaggagaatctggccacctgactcatcagccatatgaaatgttgagatgtggggtttatgggaaacacacccctgacacacatactctcaagaggaggccgggtggacagtgtaatgcaggggagagagaaactgatggagagcgatcagtcaccccagatcctgcacatggcacacgaggggcttcaggtgcccaccgctgcaggcactggtaccctcctcatagaggggtctgggaaggggagatgccacccccagcccagctcaggctgacggcacccctgtgggtggtgctgggcctacagtctgccacaggcagctccacggtccccaaatggtccccagctcctcccagcacccagcacacagtaggccctcaatatttgccaaatgagtcaatggatgcacactttagtcaggccactcgtcagggtggggtgcagggccagaagggagctgcaccttccttcctcctcctccacccgcaatatacctctcaaccacttcccttatgcttttttatcttcttccaagaatgtgattaaggtttcctcacaggtactcctggcttcgaactgcctggagacaattctgataagccctggattcctggatccctggatccctgggagcccccacaaggtgcctggcaataactatctgctcaatgactgaatgaatgaatggatgaaagggtacctggcctacgggaagctcttggtaactgtggcatgaataaatgaataaatggatggatggatggatgaaatactgaagtccagggcttcgtctaaaggaggcacttgaaaactatggtatgaatgaattcagaatgagaaaatgagaaaacgaatgaatgaatgaatgaatgaatgaatgaatagtctaatcacaaagaagcagcaaggagccactcaagaggcccctgtaaggtggggcctaggagttggggacagagcctccagctggaagccagggagtatataagcctgacctgaccaccctcctgaccacctgggtccagtggggctgcccccagcagagcctgtccagcatcaccaaggtccctcgggccccctctcattatggcagaatgcaattactccagtcttcagtggggtctgaatttgttatgattttatttgaaagagcctcttggagccagggaagcagcaagggtgtgggggtcaggaagcacggacggaggcagaaggaacagctcagctacacagcctcagcctgaatcccagagaaatgacattaaaacaaaggagacacagagctggggcagggtgtggggggatggggggggagcttacttattcagaccagagccaaacaaatggatagatttaataagataataagctcagattccatgctcttaaagatacagactggggctgggcatggtgactcacacctataatcccagcactttgggaggccaaggagggtggatcacctgaggttaggcgttcaagaccagcctggccaacatggtgaaaccttgtctctactaaaaatacaaaaattagctaggtgtgatggtgggcgcctgtaatcccagctactcaggaggctgaagcagaattacttgaacctgggacgcagaggttgcagtaagccgagatcgcaccattgcactccagcccaggcgacacagtgagacttcatctcaaaaaaaaaaaaaaaaagacacagactcaacagtgggatttggggtgggagtctccatatttttccgggaaaacacccctcaagtggatgcctttcttcacacaccacactggagaataagggtatgtgaatatgcatgtatatgcttgcaggcatgtgtgtcttccccaccaggggggacccccaaaactcaccagaaacctccttacttcctaaccaggacctgtgaacaaatgcacccctccacaaggaacacacagccaagcagtgcccttgtaattttttcaggaggaattcgggccagccaagcacaagtcggtgtcacctccttcccagcctgggcttccctgtctctgtccaatggaccaacagtaaaaagtgagcacttcccgctcatcttgggaaacacctcgcatccactcactcaatcagccagcgactgcactgttgaaatatttatggagtgcctcttctgtgccaggctctgctgcaattcctggggcagtgagcacacccagcaaagccctgcaccatggaggctgcattccgggggcatcaggatcatgtccaggaaggctctggagccagagagcctccgttcaaatctcagctctaccactgaccagtggtgtaaaccaggatacgttaatggacctctctaatcttcaccaagagggaaaacaggcagaatcccttctgcctcctcgggttgtgcacaggatgagatcagataccgcaggttaagcacactggcccagcgcctggtacatggcacatgctcaatgaacagatcattgtgtgtggtttccagtccagtggcagcaaacacagagaccgctgggcagagccgtggttcactgtgagacccccgcccttggggaactccacccccactcccaggttacccttctcgcgggcatccccaatttaccacctccttatgtcattcctgccaatgtcatgtcataaagaaagccagtccccctgaagggctctggtccaccccaaaaagtccttaaatcccttctacaaagaggtttggtcccttccaatgaaggggaatccactcccttctgaactcccttagtctgcaggaagaaatgatctcctgatgagccccaaaggagggcctgctgacctcctctcagggacaggaataacaggaccctctgactccaaccatcctccaagaggaaggacaaacagcgagtcacctgcgatatggcagccattttttaaaatgacattgcaatttacattcatttattccttctataaatacgaataagtgcctactctgccagccctgttcgaggctctggggatagggtatgaagaaacaaagtccttgccctcagtgagcttacaatgcaaagagaggagactaaatcttcctgctgaagaaggaataaatcagtccgtagtaaatcacgtgttgctatgaagaagtgcagggcaggaaaagggtgaagggtggggtgccactctggacaggtgacaaggcgacacttgagcagacaccagaagcaaacaaggcagcaggccaaggcagaatctagagagagaggatcccaggcagggatctagcaggtgcaagcaccccaaagccagagcatgcaaacttttcagggcacattttctgagatgcccacgtggggctcagtgtgaaggcatgtgccctgccttctaagatcacaggccaagctgtcatccaaaaccccacagggacccaaaatccaaccccagcatcaactcactgtatgatctgactctggtctctcaacctctctggtcttggtttcggcaacagctaatcagaactgagcattatccaagcaggcgctggcagaggaggcccccagagtcctcccgagtctgcagctctatgcaaagcgcacccaccattcctctccaccccatcgcgccattctcacaccccgcgccagcaacaccacgcaggattggtactcctgccaaaatagctattaacccagtagccaataataacacgttatcctatcaatttgcttctgaaacgctgtgtaattgcagaacctaagtttgccatctcggtagcctggttaccacataaacagaaagaaactcaccagcctcttcctgaggagaacaagtggctggccacgagaaacacccgattaccactgaggccccccagcccacccccctcgaggccctacagaatccatcaggaatcatagtctggcattcagtacttcagaggctagtctcaatgtccccttggcatgccgcccctgtgactggagaggggaccagtgcccgggatgggatggctttttaggtggcaaagtcaggcccggcagctgcactctggtggcctccctcccggccagtggtgcaggaagtgggacagacatgaggcttcaggagggcacgggagagggcaggagccagaggcaggcaagcacttgagtgcaaaaaccatcacagatgcaagccagccctccccacgggagacagaggggacaggaggtcaatgggtggggcacagagggaaggacaggagagaggcaagggagggactccagacctaggagtcagggtgcaccccagggccctccccatccccatgccgcagggccccacccaggtctgacaccctggccaccaccacctgcttggcagctggccgcccacttttcctctctcattccagaaaaaaacgtttccttccttctggatttcattccactctgagcaaacattccactccccaacgcgccgggagcctctaaggggactcggcgttccggtgcagacaccagcctgttttattcattcttcccccttccaacccagccaccccctcatcactgtcccatgcctccgcttacctttccccctgctcaccagggcgtcccagggcaaactggccgatgccaagagggccagaacctgagcccgggttcccagcacccggcggcagggcaggcgagggctggagaggcgcttcccaccggcccactggtgatctcagccacgggacgcatccccacccggccgcctgggccggcggagaaggatgggccgagggtgtgctgctcccgcggcggcgcttggcggaggacccagctagcgggagaggaagggccttggggaagaaaaggggctgggaaaaggcacagatggggagggagaggacagaggaggcccagggctcaggccacgcggccagatgttgacccagttgagggatccaggccccgggggcgaccgaggagttctggctcccctgccagctctgagattctacagagatggaggagggcctggggccggcgccatgccagggcctggtgctgaggctggggttaaagggaggaccacagaaagggagcaaggggtctctctcggacactgcccctgtctgccaggacagggtggggggacggcccctgggaggcccctgggtggggtgggtggggagctgtctgcgggaagcagctctcagcaaatgaaaaccaggccttggaaactggccgggccacagccagggcacagctccagggaaaaccccgctgctcaccgaaaggtgccccaaccagagcgaaaggtgatgttaaaatgaacgagctaggaggggccaggcagcttgagcgagatcgggggtggcccctggctacagccccacgatccctgctcttttgtgctctgaacgcccctcattgtgggcacattgtactcccaaggcctgcttgcctgtaagtgctgtaaaaagccaactaactgcgcaattttcttcccttggcttccctccgctcagccttggtcaggttatcagctgagctgggcctggggctggggactggcctggctaggcaggcctgaagtccccacacccgccatatttggaaattcaactctcaacggtgcattgaggcccaaggggtggcacttccaaattggtgggacaccagggttctgccatcaagagcttggtgggtagcggcattcagtaaatatagatgtcacccacacatcctttcattcattaattcacccatttagttattcacaggatgtctctgatgtgcctacaacccagcaggcacttaggtggtgagggtaggagggtgagccacactggcagctcttggcctgtggagctcgcagcctaggtggagggacaacatttgatcccctgtgtttgctaggagaagtgtgtggggcctggggggagaacaggggcgcagtaagggtgccagagccctcctggaaaaagcaggctctccgtggagaccagcaggatgaagaattcaccaagtgaaggaagcaaggggcagaaatgagctccaagcggcaggaccagcaagagcaaaggcctggaagtgagactgaggtctctgacaggtttcacggagcctcctccgctcctcactctcagccacagtgggtggcccagccctggtagcaccgccccccaccccagctcacagactcggggagccccccatcagcacctctggaggccaatcccacaaagccatcatccagccgtctctttcccagctgaagttctagttaaaaatgttttcatatgtttatttttaaggggggatgggaagacagaagggagacctgaaggtctttttcttttcagaaaaaaagaaaattaataaataaatagagcctcaagaaaagggcatggaaaggtctctgcatctgtaaccactgaacaaattaaaattagctcatttaatcagctcctaatggcctggctgtcccgagtgggccccggaacacagcaaacttcacagcagaactgcgcaggccaatgtcagtttatcctacaacaaagggattttctaaatagtgcgatcaaaacgcagcgaaggccggggagagctggggagacggaatgcggccccccagatcctggctggcccccgcctcccagcttcgtccctttgaaaggaattgttcttttggcttttgttctaattatctaaacatgtgtgtaactctgttctacaaagagtgttttaacccgcagaggaggtaactgtagcccctaccatacgttactggggccctgctcccaatcctcacgcctttaatacttctccattccccacctgccttcgacagaggcgtaaacacacctacgacatacagccacctacacacgccagttacattcacaaacacagagttacaaacacacagttctatacacatgatcacgtattaaaccagctacatacacgtagttataagtgaacagttacatacatgcacggttgcctattccacacacataaagttacacagacacacagttctatatacacagtcacatataacacattacatatgcatggttatactcaattacatgcatgcatgcacagttacattcccagagttatatacaccacacacaagtacatgtgcacacaatacacacagctcctcaagctcctgcctaacagctggagatgggggaggcccagctcaccagacccccagggagggccgctgggtgcacacctgaggcccaggctggtagtaaggactcttatttccctggagtagtttctctacgcaacttgccacctgggctaaatcattagggcaatggaggaggggaaacaaaaggccaggggagtggggctgggaccccagaaaaaagggcagggtgggaaagcatgatgccaggggtaagcacaagcccatggcccagtggggaggaaggaggccagccccatcaccgactccatcaccaacaccgacctcaaattcccttcccatggcctgtaaactggccagtctgcagctctgcctttaggcccagagcctccttgggtgctcagcccacagggaaataagcctggagtcagccagatcttgttgaaatccaactccaccacttactaactctgagcctccccttcctcatccaaaaaataagaaacaacagtagtccctatcccaaggggcagttgtgctgatttcattagagatgccagtaaaatgcctagtccagaacaaactgggtcagtgtttgccactctggcaaatgaaaggtgtgggcatggaggcccgagaagagaccatcagacagtgggtcggggcacagccagacaagagctagccatttggtgactttcaatttcttattcaaccctcatcccccgagtgaggaaggggagaattttaaaactggataaaagaaattaaacagggtaaaaagaggaaccaactgggatggagggaagccttcagaaaacttctggcccagagtcagaccattatcttctgaagacctgctctataggtatttacagcaacaccctggggtaaaagcaattgttatctccatgtcacagaaaaggaaaccgagggctgggcacagtggcccatgcctataatcccagcactttgggaagctgaggcaggaggatcccttgagcccaggagttcaagaccagcttgggcagcatagcaagaccctatgtttacaaaaaattaaaaaataatttagccaggtgtggtggtgcacacctgtagtcccagttacttgggaagctaaggcagggggatcacttgagcccaggaacttgaggctgcagtgagctatgactgcaccactgcactccagcctgggcaacagagtgagaccctgtctcaaaaataataatgataataaagaagaggagcatgaggctcagggaggtgagaagcctgggctggcagaggcagtgtgcaaagaggtctgtgtggctgcaagctgcatgctaatgcccagccccgctccaccttccttcccgaggcaacctgttctcccaactacaaactttctttagcaggactccagcaggtaggagagcctgaagttggcttctggctctgggaactacaagagcctcagaccacccaacccaaactcaggagtgtggcccttttccttgcaggagttcaccaagtcctcaagcccctaccccccacccacctcccatgctgagtaggaggtgggaaagaacctgtacacagaggccttactgtaaaatgggaaaacattttacagacttagaaactgaggccccgaaatggcaggggtgggaggctcaaactcccacaactcagaggctgactctgcaaaccttgagtcctcccaggatgggactcctaccttccttgcccttctcttgcccaggcaggtcctcctgggatctattaggtgagcagcattgttgagaccccagggagtgctcagaaaaagaacctggacacaggctccatccagaaggtcccactgggctagtggtagctgtcctggtcctgtttagggatcctgttttccacttgattggcagggcccaagctgacccctggtatgcctggaggtcagccaagatacagggaaggtggcaggagggtcagagccacctgatgcagcctcagtacagggagtaggacctggggaaacagttcccgctaacccactaacgctgcagacccacagcctgcaggctctcccagccccacccccagtaagcaccaggcccccaggaggaaggaggggtgggcagggaggtaagcacatgggctcgtgtttgaatcttggctctgtcatctacatgctgtgtgacctgggacaagtgacctcccctctctgagtcacaaacctcaactataaaatgaagatggtgacagtgcatgtctccttccttacttgaggactgaagggacgtttctagctcagtgtctggtcccccttccccagtggtaacccttagtaagcacagagagtggggagtggggagtgcagcatggtcttaaatccatctcaaccatgcgcggcagctcatgtctgtaatcctagcactttgggaggccgaggcaggcagatcacctgaggtcaggagttcgagaccagcctgaccaacatgaagaaaccctgtctctactaaaaatacaaaattagccaggtgtggtggcgcacacctgtaatcccagctactcgggaggctgaggtgggagaatcacttgaactcgggaggcggaggttgcagtgagctgagttcgcgccattgcactccagcctggataacaagagcgaaactccgtctcaaaaaaaaaaagaaaaagaaaaagaaaaaagaaaagaaaaaaaaatccatctcatctcccacatggcgaccctagaggcccaggccaccatccccaatgagtgggatatggggcacccttctttcagatgcagcaggactgtcccctgcccagcacagattcatctcagccattcttaagctaagcccagcaggcagccgacagggcagcccagaggacacggccaggccaggtggggtgcaaacctcttccttacgggatctgggcccaccaggcaggagttggacctagagaccccttggaaagcccaaaacttccctctcttaccatcaggattcagaagagaaccacatgaaaaaagagttggtgatatctccccctgcaccccctcaccatccaggtcaccccccacacagagcccagctgggctgggaaatcgggccctagccagggctcctgcttccctactccagagccagatggccctacacaagcctcccttctactctactccaagcctcagtttcccctccttggctctgcttacttcacagggctgcagtgagggtcagaggggaatgatggctgtggagatgctttgtaaactgtcgagagccattgccacacacgggattattgagggtaaccaggataggaaggggaggagacgccaagggcaagccccatctgtccgttcccctgcatcagggcagtggccccaccacgagaacagaggaaaaaaggccaagaagacaaagtcagggaggctcacgccagggctggatgctccctccagggccccagagtgcaggcaggagctgctgcagcccagcagttctgtttggtgacattggaaggggaaagcagacaacatgggtctctgggatgcggccacctggctcggcacccagcacacagtaggcatcacccactggttgagttctcccagccgccaaccctcagacaacctgcctctgcgagagttcagtgcagatgcccacagatggaagccagaaaaaaatatgactccttgcaaaagaagcagactgcaccatgtgtcccagctcagcaggctggtcccaaggcctcagaccccctcatggctgtggccctgtaaggatgggaaggcatggttttcccacttcatgggtcaccagcagctgtccctacctgcccaactctgccagcaggcaggctcaactagatgcaggcagccaacctagtgccaaggaataggcagaggaggagttggggctgcattctagtcctgcccacttttgccccctgtgccatctgcatctcggggacgcctctgttggggactcagtttccccacatgctccggctccccctgccccataagctgtgaaacccaagcaaaacagcacgctgcctcattctcagccaacgtaggctacaattaatctgaagcagggattttcttaattgctgggttttacaacccaatcgcaaagataaattacagctagctgacaacgccggcttgaggcgagacgtttaaagcatcctttttaagtgtgtgggctctttaaaaagctggtatgatgggaatggaattgtgcttgcagcctagatcggaggctacttcccttagggagtcaggccagcaacgccaggggacaaacctctcgaaggagatgtcttattggggagtaaaagtaaatacataaaagaagggaggtccacctgcaaccctcctaattgccttccttcacatgcagctgcagttccacactccacagccccttcaggtgtttcagcgccaacaggattcccgggactaggaaggcccagcttccctcattagctgtgcctggtcacccagggggcacagaagaaatggtgtcagcatgcacttggcagtgccctccaacacaaggatgactgccccctgggagaggcagtgagggtaagggacgaggtgtgaagggggtcccctctgatcttgttcttgcagggagctcaaggcctggcagcagccacgtccaaaacagacaaaccataggccctgggtcctgtagcccaccctaggaccaagcccggccttgatagttccatgaggtcccaagcacgcgtccacccgctacagggtgtcccacctccagccaagaggaatagcatgggtgtgcatgtgtgcatgcacatgacttccaagcaaacgagccctcccaccaccacccaccccgccctgcatggccaagagtgggaggaagaaaggaataggaagaaatccggcagtgctgctctgtgtgatgggtcaggtgatggctccacctaatgtctgctgagcaattattccgggagaggtgccccacacgttttattttattttttatttattatttttttttgaggcggagtctcactctgtcgcccaggctggagagtgctggtgcgatctcggctcattagcaacctccacctcctgggctcaagagattctcatgccttagcctcctgagtagctgggattacaggcagacaccaccaggctaggctaatctgtgtatttttagtagagatggggtttcaccatgttgcccaggctggtctcaaactcctgagatcaggcaatctgcctgcctcagcctcccaaagtgctaggactacaggcgtgagccaccgcgctcagcccacatcttttatttgcctgtccacaactccctaccccaaacccaaaccgtcagatgtggtccaaaattcagactttttcagattctagaaaggtgagacagtgcacttgctgcaaatttgggaacactccagcagcagtcaggcacactgatacttctgcagcaaaacatatcggtattcactaatgtgaacgaaataaagaccataaatagcttcacatcagctcaggtcaaacttggctgccaaatacattacagaaaaaaaaaattcaggtttctggctttctggaattcagaattgtgaataggggattctggacctccactgcctctttaatcttcctggtgaccctgtggggtaggtactattgctactcttgcttcccagagaggaaagtgaggcacaaagaagttaagaaataatttccccatagtctgtggggcagcagggcggaaaccatggccatctggcctggagggtctgcactctccatccccagggtgtcccatagttgaccaaagtacggagctgcagtttaaaagcctcctgaggctgggcatggtggttcacgcctgtaatcccagcactttgggaggccgaggcagatggatcacctgaggtcaggagttcaagaccagcctggccaacatggcgaaacctgtctctactaaaaatacaaaaattagccaggcatggtggcacatgcctgtaatcccagctactcgcgaggctgaggcaggagaaacacttgaaaccccaggcaacggaggttgcactgagccgagatcgcgtcattacactccagtctgggcgacagagtgaaactccatctcaaaaaaatttaaaaataagtacaataaaataaaataaaataaaagcctccgaaaaaagagtggagcatctgtaaatgtaccgagtgtccacagcctgccccaccacgcggtgtgatctatgggccagcctccaccaggaggcactcacctaggagttacacaaaccctgagtggcattcccacacctgcccagagccttgctggagcccaggagcccaaggcggtctcccaccagcaggtgaggctcaccaccccgccgtggtacacaggtaattactccctacctgacacagtctgcacagatcattttacccacaacaaatatgctaaacacagccccaggccaggagaaacatgctgcaggtaaatcccatttgacaggggctgaggcttccagcaggactcccagatgcctttgggaggagtggtgaccccatcccatcaaaatgacattggagccccacgactcccctggtcatctccaacttctcttgattggcaattttttcacccactgggaaagattgttgcataggcaaaatcctggcattctattaccaaataattacatgatcatttcataggcattaagacactcccaccagcgtgagcggtggtgtccagcgctaaccgaggctggcctggactgcgggtgcttgttaaggagaactccagcattgaggaaaacctccagctgcagctcccacactgccctggtttctaattaaaaattaaagcaggcatctttcctcagaaacccaattagcatcaagctgatggtacaaacacacatgtgcacaaacacatgggcacacgtgtgtcacatgcacatgcttatgcaaggtgtgcaaacacgtatgtatgcatgtgcacacacttgcacatgcacacaaacccttctgcccatggggggctacaaaccgccatctggtcatccattcagtctaccctgatgaggattcaccaagcatcacgcactccacgtgccccacaggaagaaacccagggccctgccttcaggagcatgagctctaaaggaggctgaggaaagtgcacaaggtaagacagtccatggtgggaccttaaaagggtccttaggaagcccagagagctcagttctggcagggtgatcagggacaccctgagacatgaaggcctgctgctgggtcttaatttatagaaaaaaatataaaaggccatggagcaggtagagaaaatagccagagcaaaggcaagcaaaggtagctggcactctgagaacaaaaattattctgagtgaaaaataggcaggtggaaaacgggtaaatgtagataacacaagagttctagcatgggtacttttttaaacctatatgaatttagctgtgtgctgagcaaaaagaaaatttgtgcacaggatctgagataggaatgagtgtgaaacgcaaacaaaattttgctgtgcagtccaacagctgatgttccagtaacctctcctaaagcaagtgtcaccgagtgcctaagggatttgtggtgtgtgtgtgtgcagagcacgcagtgtgttctcggctggggagcagtccagtcggtaatcctggccatgtgcatacgtgtgctgcagccgatgtgtacacggtgcgtcatcccactttacaagggaggacagggtggctctgagacgtgatgtcactctactggaaacacaaaaccagtcagggccagagcccacatctgaccccaggcagtgtggcccagagtccaccccctgcaccaccaggcggaacagagatgtgaacaaagctgtacttcagggaaaataatcaggcaggggtcctcaaggtggggtgggacaaagtgaaggcacagaccaaagcccgagaggcagccacgcagtgctgtgcagaggggcggaacggggctgcagccacagggatgctctgaggccttggaacagatgggaaggcagggaagagggcaccaggggactctgcggtctgagtgagattttcttcggtgactacagtttgtgagctcccagtggccggtttgtcttagaaagggactgagtcccagcccttcccctccaatcatgaccacccctgcttcctccatcttgcccttggtgagagaaaactccagcacaccaagatgtcctgggaagtccatccttcccaccacccaggtagacaggatggcaagcaggcaactgaacagccgcccagggcagagcgggaggcctgtggtgtgtggaattcatctgctgtgagatgatgctatttcttcatgcaacatgaccagggttggaaagataacactggaaacaaagtcaacatttatagctggtctactaacatgctgtgtgaccctggatacatcactaaacctctctgagcctcagcttcctctagctgttgactcactcatgtacagaggacccactatatgccaggtataagctctgtagttggtgacctttgcagttggtcagtgctgcatggctcatgggtctgaagcccaccctggatcatgcaggagaggcacgtacccacccaggtgctggaaccattaacctggccatctttgactaggaggcttgggaattacagcattcagccactcccagaatcccctccctgctggggtgataaccagcactgggggtgaactgccccacccctccctcagcggtgccctcagctggaattgggcacgttaaaactcagactccgggctgccacggcccccacaaccacgctgcaccaccccacccccctccagctgcctgtgcgccggctgctgctgctgctcatttccaggcaaatgttctagttaattaaaacacacccaagtgctcacacgcacatggagccaagctacaaaatcagttctaccaaacagcagctcctctgctccagcctgggatcgatgcaggccaggacaggggttccaaagttgatgttactggcaccgagactttgctcataagaccctacctgtatacacacctgtacacaaatgtaaaagcatatgtgtgcacctacacacgagcctgtgtgcacatgcaagccatatgtgcatgcacatgtgtgtgttctgaacacgtccatgagtgctccacacacaacactgtgcagaggtgtgcaacatccacgcacacacgcacctgcatacatatgcatggacacactcacacaggcatgcacacaccccacagtgcccccttctccaggaagtcttctccagctttttgggccttccagctcagaacatcagccatggttagtaaataaacacttgctgcatgagggagagaatgaataaataaatgaatccactgatcaatgatacagtgggcaaacgggaacagcccacaagtacaattatgcatcaccgcagattggattttccagagactggaggcgcagctctgcccttgcagctgtgctgcagagctccacgaggcactaactgagatacacacacacgcacacgggcatgtggctggaaaatgcacattcccagatctggacatccataacaaccaggaactggcaagggagggctgcagtcatccaggctaggagacagaaatcagtcacctttaatgggactttagtcccagaagggaaggtgcctggaggtccacaaggctgcctgacattctgggactaaatcagacacatggccttcacacaggcaggtgactctagggaacaaaaacagcctggagtaggtcaatcctgccctagcaagcatgtccagtatgctccaggtccaccgagaccaccttgcaggtggccacttctgcagccacaaacaactgttctttatgaggacctgacactcatacacaaatgtcaaccacttgacaccctagatgggcatggaaaggatttctgttcatggagatggggacagctgtgctgggcacctcaaaccacatcagttgaacaactgaccttctaactcatgccacggggctggcaaagctgtctacagagagcaaaggacgtgagaaggagggtttagaaaggagtggggatggtggacttagcggccatgggagtcagccactcaaaatgtggccctggaccagcaactcagcatcacatgagagctttttagaaatgtagaatttaggccaggcctggtggctcatgccagtaatcctagcactttgggaggccgaggtgggcggatcacctgaggtcaggagctcaagatcaccctggccaacatggtgaaaccccatctctactaaaaatacagaaattaccctggcgtggtggtgcgtgtctgtagtcccagctacccagaaggctgaggcaggagaatcgctggaacccgggaggcgaaggctgcagtgagtcatcatcacgccactgaactccagtgtgggcaacagagcgagactccaacatagaaacaagaaaagagaagagaagagaagataagagaagagaagagaagagaagagaagagaagagaagagaagagaagagaagagaagagaaaggaggggaagggaggggaggggaggggaggggaggaggggaggggagggaaggggagggtaggaggggaggggaggggagaggagaggagagagagaatggaagggaaggaaggaaggaaaagaaagaaaaagaaaagagaaagaagagaagagaaaagaaaaggaaaggaaaggaaagaaaagaaaagaattttgttgccaggtgcagtagcacatgcctataatctcagcactttgggaggcaggaggattgcttgagcccagaacttcaagaccagcatgggcaatgcagtgagaccctgtctctataaaatttttttaaaagtagctactagggaggctgacgtgggaggattgcttcagcccaggaagtaaaggctgcagtgagccatgatcacaccactgccctccggcctggataaaagagcaagaccctgtctcaaaaaaaaaaaaaaaagagagagagagagagagaatgattagaaatgcagaatttcaggtccacctggagctgctaaataagaatctgaatttcatacattccattagtaattatgttaagaatgaaatgaaaatatgacattttttggccaggcgcagtggctcacacttgtaatcccaacactttgggaggccgaggcgggtagatcatttgaggtcaggagttcaaagccagcccagccaacatggtgaaaccctgtctctactaaaaagacaaaaattagctgggcgtggtgatgggcgcctgtaatcccagctactcgggactctgaggcaggataattgcttgagcttgggaggtgaaggttgcagtgagccaagatcgcgccactgcactccagcccgggtgacagagcaagactccatctcaaaaataaaataaaatattacattttatttgaatgtatgtgttttattttttttttaaagctactatgctgttaggacataaatatttaagttgtttagacaactgtgaggtttttgttttgttttgttttgttttgttttgttttgcttaaggggcaccataaaaaagttaccgacactaaggtgccatgaactaggaaagtggggcgttcgagctctgtatcaggcatggttttgggtgatggcaaaacagcagagaatatcacaaagtccctgtcctcgtggagttgacagtccagtgggggaagcaacaataaaccagtaaacaagtgactgggcaagatgtcagggaactggaatcgaataaaaaaattaagcagggcaaagtattgattgccacctaccatgtgtgaggcactggcctcccatgctgtcctccctgtgccaggtgcctgatgggtgtctttcctccctctcctcacccctgcactgggaacaacctccagctcataatttgcactgacagatgttgggtatggctgtctttcacttgaaattttcaaagatctcacagaggtcctgtaggttagctgttgtgccctggggtgccacagcacacagtttggggaaaccaatctcaactatttattaagtgaatgaatacaaatcatgaagaggatctgacatgagatacaggaatcaattctcaatccatacaaatgctcagagataccttggagcactggctcacaacaccagccctcactgccctgagcctatcaggctctctgggcctcagtcaacccagtggtacacaggtcaggagcccacagtgactcgcaagcacactcccgggctcaagggatcctcccatctcagcttctcgaatagctcggactacaggtgtgtgccaccatgcctgaaaaattgtttttgttcagtatacacagggtctcactatgttgcccaggttggtcttgaacccctgggatcaagaaatcctcccactaatggcagcagcacccagtctggagcgaccgctgcaaagatgccagctgcagttggggaggcatggccagggctgcgccctccgtggagctggcgggagccggaaacaggtgggatctctgcccccttccaagttggcagggtgggatccccaccctccccagcacagctgcagccacctagctcttgggagcctgggaggcccccctctcctgtcctcacaggctcggaagtgcctgctcctgctgcctggcttctccctgctcccagcaccctctctgattttggagcaaagttgaggccaagcccagacactgtcatgacccggccagatgtgcatgcactcagggcagtgctgacatgccagccccctgccacctcagccccctccagacttttggtgcagatgagcatgggagggacaccaagagggagctaagggtggctcagcgtgggcctgcaggtgcccctcggcacaaacagtctgggtgctgtggatgatatgattgatggtggcaggaagcagacaggctcctgagcagaaaggggcgggtccccagtgaagccccacgttctagccagaaatggcctgaaacctggggtctgggctgtcagttccaggtggagtcccagcccagagtgagaacttatggtgctgtttctgggaccacccaaggatcaatcagtacgcacttcctcccttctgaagcccattacaccagactcagccagactcacagagatgttggaactaccagctgcaggaaggagctacccacttcgggtctcctgactcttcaggacaacctacctgtggaaaagagctacccactgtgggtctcctctgagctgagagctggacacaagttagtacaacctgtctgtggaaaggatctacccactgcggtctcctctcagctgagaactagacactcatggggacaacctgcctgaggcaaggagctacccactgcagtctcctctccactgagagctggacctgcctgcagaaaggagctacccactgcaggtgtcctctcagctgagagctgggcacttgttgggcgacctgcccatgggaaggagtggcccacttgaggtctgagaggtgttctgtcactcattgaagctcctctctgccttgctcactctccagttgtctgcatacctcattcttcctggacatgggacaagaacttggtacgtgctgaatggcaggacggaaagagctatgacacaaacagcacggaaaaacactccctgcttaccatgttgcaggcaatgagaaggacagaagagctgcagcccttcggtgagcccagacctagaggctccccaagccagggctgtgacaccttccttggggttctgtggttcctggcatctccaagcttccggacaccactgcattccccagtactcccagtggaagccacttacagtacacctggtccagccacagcctcacatggaaccagcacatggagctgcccgccccaccacagcagccagcatgcctggctgtgtgaagtggccggacttcatgctcacttgcctcacggctctgcacctggatcacccttggcaggtatgggatccaggctggtagcatgagccgagcacagcctgccaggtcaagggtgcagaacgagcccagcaggcatgagcaatatagtcaggcagaaggcactgctggccacagaggtttctggctggtgaagcaacaccccaaggatcctgtgacaccaacttaggctcccaaagtgctagaatcacaggtatgagccaccatgcccagccaagggcaaattttctaagaaatgtcggtgtccaaacagggcccctcagctctgcacaccttagagttggagcagcagacctttccaagtaggagaccaacaggctcgcccaaactcgacagtcagggattcccacttctggtgaacaaagcagaaagcactatgtggcggactcagtacaaactccaataggaaaggaagcgagaagtgaagggtggatttggggaaaaccaactgaacaccaaggtatcttttatcctaagccatgactgcagctgctctagtttggggaaaataaaatccaacagcatccagactacacagctcccatgtctaaataacaaaatgaaacatgggctctcttttggcagctttcttccccgtcagcaggagaactttggtaactgagtgctttttggggatacagagaggggagaaaaactctcatgtactcacgctgccaagttcacatcagcgacaggctttataaagcaaatggggcagatgtataaaccttggtgctggaaggatggactgggagattaaatgacagggtgtgtgcagcaaagtagagactaaatgagacctcaggccggatcgtttcaccacgatatcagggacttcaaagggatggctcccaggcctggcctgccagcaagggcagcccacaggcgtgcccacccccacagcctcggccactcccccaggtgcccatgggttcctggaggctgcagggatctgaatgctggcttcctggcctttcatattatgattttctttttctttttctttttaagacagggacttgctctgttacccaagctggagtgcagcgatgcaatcatggttcactgcagcctccacctcccaggcccaagagatcctcccctatcagcctcccaagtagctgggactacaggcacgcaccaccatgcccaacattatgattttcaaatatcagaattctttctgtacctaacaagctcccacccctcacagcccccatgtctatctccccttttgctctctgcctcccctcatccttcctccattccctccatttctgtcctctaattaccccccagtctcctgttcctcctccccttccccttcggaagccagctctcaccctacccatgtctttgctagcactcggccagtttcctctctgctctcccagagggtctgtcctgcctttctgcctgctcctgtcttcagccttcctcctgcccctttttctctcaaccccattttcccccaaccccattttccccccattctccaaccgtctccctggacctcaagaaagaaagtgcaagagagtgaatgaccatgctagagcttgctgtgagtgccagggctggccgagcacatcccacccctcctgctcaggaaaggagggtgggtgcagaaggcccggccccaagggagagccaagggatgccagatcctcccggtccacacttgcaatgccagggtctggagcagggacacagcctgagaattcccttcacctccctctgcagcaactgtcctggtctaggatcccaggagaggccttgcatctggcctgaacagaacctctgacagatgggatgccgccccgagtatgacaggaggacatgaaagatgggaagagaggagaggttggtggggatgctgagccgaaggaagaagcagaggtcagtcatgaggactgcccaggttcaaacaccatccctgctactccctgactgtgtggccttgggcaaattccctagcctctctgagcctcagtttcctcatctgtaaaatgggaacgatgtccaaagaactcaataaacagcaattattttgtcatgatggcaattcttacatctgcactgtgtattggcggctctgagtgggtgtcaggacttcgacggagtgggtatctaggagacgcccctaccacaaccagcgcagagccgcaaccccaccgggcacccgtgtcatgcaagggagcctcagggctgagggagccgcttttccgcctgtgccaataaagaaggggcccttctctaggctgcagagctgcagtgcccagaggagtggggacccgccctggccatctccctgtatttctccccagtaataatcttatgaacaggtggcagaggggtgcctggcgtctgcctccaactttgctatctgactattcactcaacaaatactcagctctcccgtgtggatcagtggggcattcaacagtgaccaaggacaaggcagcccctcaaggagcccattgtctcctgcaggagacagacactgaccagcaaattgcaccctggaagtgtaaaatcactactggagaaagagctacaaataactaaatacaaatatattctcatcttaatattgaaaatacattcttatacttaatataagtgtattccttctttggaatcgcaaatttcaggatgtgggcggtggaggagaccaaccctcatctctagacagagaacttgacacccagaggacaaaggaccaagttcactcagagccgcttagtggtaacccagggctagaattcagttctcctgactccaaattaaagaagtgctttcctctatgccacaaggtacattgagaatagttcccttaggggctactgtccaaaaagaaaccgggaggaagaggggccccctgggtgattccaatatgcctggtccgatgctcaacacttgacccacacctagcaccagctcctcgagagggcattaaaagcagctacaagacagcctggccaacactgtgagactctgtctctacaaaaaatttaaaacttagccaggcatgatggtgtgcgcctgtaatcccagcactttgggaggctgaggcaggcagatcgcttgagcccaggaaccagcctgggcaacatggcaaaaccacatctctactaaaaatttaaaaattagccaggcttagtggcgtgcacctgtagtcccagctacttgggagggtgaggcaggaggattgcttgagcctgggaggttaaaacagcagtgagctgtgattgtgccactgcactccagcctgggcagcagagcaagatctggtctcaaaaaattaaaataaaataaataagagcagctacaaggaccacagaccacagatgcaggtcagaccgtgaactccctgggcaaaaaaagcagaatatattagacaccctctggttggaatcctgtaaattctcatgtgtgcagacaaagaccaacacaaaagaaatatcatcaggaaaatagggtgtttgggtaatgaggaatttttttctcaaaatacaactaactgtgttgtctgagattcatccattgaattctcaggttgtaagactatagccacatggccagattatatcagggatatttagattctcaaattgccctggggaaaattaaagagacatttgtaaccatcttgaggatgtccatgccattaattaaatgttgaatggtgagggaaatgggtctatggtgggtgcctgatgttcccattttacagatgaagaaacctccccatggtctgcccagacctggtcatgcctctgttaaaagtctgctttgggctgaagatgaagaaaagagaagctgagcccctcaaggttctggtcaggatgtgagtggccccaggacgtaactctccttcagcccagagagcaaatctaggacccaagagcagcagtccagttcatgtagggggtggaacccgcatcttcctataagccctcccctcagcttgagccctgggcccctccaccaggttaagcagcaccccacttccaccccagcccagctgcaagaaggagctgccaaagttggtggacataaatgagggggccctgacacgcggccagctggagtgtgtgagggctggagccaggctctgcacacaccaggcaaagcagatttccacgcaatctagacagcgggcggaatctacagcccagaaaggcaggggcacgcgaaccaccaacaccggctgatggctgtcctcaggctcagaggcccagccaggccagccaagagggtttacaagggagtcaggaacactggacaggctgcccccatctggggccataacaagcgggcatccggcagcccagccaggcacaacagctcaagctcaagctcagggcctccctctggaaggtagcagcccccaaaactcaacatctgaagttggaggaggaggcagcccagggcagaatcttcccccatcaagcagcatccccatcccagcaagttttaactgatctgcagccttctagagcaggtctccacaacagatattaacaaggcacctactgtgtgccaggcatggactaggtgggctcagctagggatagagcaatggaggttcctgctcacatgcagcatggggtcttgaggggactgagcagcagccagggtctagttccttggactgacaccccactgtccctaccagctttgtcccccaggcccctgccctggtgcagttcagtcagaaaaggggaaagacttctctgcctccaatcctattcctccttcagcgctgtgtatttcaggagagacccctctgttcacctcgatgcccaagccaggaaaccagggatcctcctgggtttctccaaaatttaatccatttccacaccttgtcaacgtggtccctaggacggctctcgcacacaccctctgttctcggtccccactgcctgcagcaccatcctctccatgtccccacctgcccacgcccgtccttgacagggcattggcaggaactctgccaaggatgagtctgaggatgccaagacccccaccacccacactgctcctagaacataatacaaatgccccacctggtcccacccgtacacacgctctgctggctcaccacgctcccccatgctgcctaccaccaatccccccaacatgccagcgccctcctgacttgcagtcttcaaaccttccgtctggatggctatccccataatttctattcattgtttcgccctcgtttccagtgtccattcttcaaagaagcctttgcttctctctcatgccccatgctcttccttccagatgcttccacgcctagaagataaacgtagctatttatggggtggtttgtctagctgtccttctcccccacagactggaagctccacagggggagagtccaggcctgtccagctcactgttgtatgcccagcactcagcacacagcctggcacaaagtaggtgctcaattaatatgcattaattcatattaattatgaaagtcctgctgcttgagtctcgggtaggcaggcaggaaggccagcctcgcaaccttccttagcatcatccaaagtgcaaggcgggtctcacagaggctctgtcttccatgctggggcaggaggggaccacaccgtcatgaataccaggcacgtagtggaggtgacatgaagcctcaggtatcatgtacaaaaaccttctggccctgtggagctcactgccaggaagcagccctgcagccactcggagtacacaggcctgcgtacgccccacacggaggatgcaggtcccctgtcagtgccctcccagcctttcctgccagacccaccacacttgagtggcctggacgctccaatcaccccctctcccaccacacccaggcttcctacctgccaggcttcctacctaccttactatcactgtcccctgaccaaggcagacctcttcttctcatctctaagagatttcccataaagacccaagtgactggcttctcttggaaatctagaagccatggacaggaacagatggaggagcaagcatgatctcgactcaccagccccgccagcctgtacccatgcttcctcacctcccaggcagaacccccatcatcatcagaacctgcgatccctgcaccagcctcgcatccccatcccaccttggatcgcatgttcctaaccatggagaaggcctcaccttctcatctctgtctgccccagggtctcctgcctggagggaagccccaggaagggtgtacagaagaaccagatggcgacaccccctccatgtctgccacctccccacatctggcagagcacccctatttcatcttgggtacctgagttactgttcatacaccacccccgtggtttgtcccctatagtttattaacatccactaataaacagtgggcaggcctcccagggcgccaccaagagacccctggctgggtgggcagggccttccttgtcctgccctctctcaacacatttttcaccataagggaacaattaggaaaaactccctccaggttatatttaggaaggggtggaagtgggggaagcttcctctagtaattttcattcagttgcacaggactgcctgtccccacctacccctgggctagcactgcagggcaggcaaccgcctctccccacacacgggtgcaaaccaagcccagcctctgcccagccctgattatgcccgcgtttaaaaataagatgtgaaagatgcattatgtaagacctgtaacactctcctgcccacctccgactctagaatcaaagatcttcatttctgccatcaaaaaagaatgaaagaaaggcaggaacaatgaaaatagctgcccaacatgagccagatcaaagacatgggcacagaaaatgaggaaccaggggggcctttaattactgcctgcatcctccgagtcatgtggagagaggggagaagaaaagttttgaaggccaccaggttccgtcctgctgcggctcctgtttccacagccagcaccagttcccgacaaactcgtgcctttcatttccctcccttttttccctcctttttctctgccccccacatgtgagacaggactcccagactccccagtgcttgacgtcctccagcagagagagctcagaggggctccttggagaccccaagggagggacacggctgcatcttggaaggtcctggtgggtcccaacccatctgccctcccaaaaaacagccagagggcctccaggagggacccagggacccacagtgggagcgggtgctgcagaccacggtgcggttttttttttttttttcgcaagtctccctggttgagagggaaaaaaaaaaaaaaaactcttcaaattcacattgggcagggctccgtggggcagcagatcaaacctgaggcccggctgtttgagctcagcggcagaaaaaaggattgcccagggaccgagcttaagtagaagctggattaaacttcaaacacaaactcctcctttttctacacagcagacagtcatggctaatattgcaatatggactctaaaaatgcattacaaataacttactctggacccagacttgggtcttttgtatcaaggggaggagcaagagaaatcatttcaacagaaaagacataggagcccgccctcttgctccatagagggaagccgctggaggtttgggccagggaggccagcgagatccccgagtgacgggaaccttcaggaagatgtcttgctggcagcccgggcggctcccccggaggctgaatgaggcttaggtcttcctaagttgggagactctatgtatattttatcaaggaagaaatgccaggccaaggtgaccaaaacagcggtacatttcaaatgtctagtgacttaaataattaaagcatttacagcactcatgctcttaaaacacatccacaaacaatggaagatgattgtgttattcacgtgataaatgagagactcaataaaaaaggaaaacttacaaactcccgatgccagcaggcagtgtggtgggtggggagcagaagacagatttcaagctgtaggattggcttctttcagcacctccagttaccctgtggttggtgtcccatttctttgagaatggccacgctagtatccactccacggaagctcctgggccagtggctgtcctccagatactagcaagagcctagagctggaccaggagccacctgcactaccctggctcccgagacagcataccaggcacctcaggagatcttggccaggagcacagccacacaggtgaggatttggaggtttgggtgtagggatgagaaggatttgttcctactgatgtgttgattcatgtgtttacccggggcatgggtctaagattgtgttgtataataaagaatttggggctggacacagtggctcatgcctgtaatcccagcactttgggaggtcaatgcaggaggatggcttgagcccaggagttccagaccagcctgggcaacatggcaagaccccatctctacaaaaaaaaaaaaaaagatgggtgaggagaattagccaggcgtggtggtgcgtgcctgtggtcccagctgcccaggaggctgagtcaggaggatcgcttgaggggtcaaggttgcagtgggctatgatggcaccactgcactccagcctcggcgacagagagagagaccctgcctcaaaaagaaaaaaaaagaatttaggccaatatttgcaaagatatgctgctttcctgaagtattttcagaaacattaaaagcgtgccccacacctccgtgacctccaggaggtcgaggggtgtcacagtgtctgtgacggaacaaggatattgccctctccctacactccacaacacccagccagaggccaagaggccttgagagttactgcaagcaatcccgtgtggcaccccgggggccccaaaggcatggtacaccattgctggtatctccacacaactttaccaaggtcaggaacaggcaggtggtacctgaggaggcatccaggctggagatgcatctgggaggggtggctgtccttcccccgaccaaaaaaccaaggcagtcctccctcagaatggccacatctctggatctcacaagtcctgaaaggctcccaggcagtgacccagctctgccaccagatagctcaatagccaaggacactctcccaggtccactgaggatggtagcctggactgtttcactctgccccacctgccatccccaggaaaggcttcctctccacaccctactccacctccctgcacccccaggggtgtcctgttctacacaaaagggcacagaaccaccatctactaagtgcagcccagtgtacaaggcagtgtgccagcccttcatgcccattactgccctgaaccctcatcgccatgcaagagaggcttcagtggccccatttcacagaggggtaaactgtggctcacaaatacgttaactgctaaagactgtgggcagagaaaaaatgtgaacacagaactgtcaagatccaaatcactgggaggccgaggcaggaggatcacttggggccaggagtttgagaccagcctgagcaacatggtgagatcccacctctagaaaataaaaagccaaacatagtagtgcacacctggagtctgactacttgggaggctgaggcaagagaatcgctcatgctcaggatttgaggctgcaatgagctaagatcgtgccactgcacttcagcctggacaacagaccaaaactctatctctaaacaaaaaacaataataattcaatttatctgcttttcttttcatgatgtgacatcatctcccaggaattcttcagagcttccacccctattaataaatccccttgcagagaaagtactgaccagaggggttctggaggaggcagcgagggggtaccactgggttaccattggataaacaaatggattatccatgcccgacaggcggtgcctcctggaagccttattacaccctataggggcacacagagaggtacccccgagcgctcccaacaggagtcactggaggatgggagggggatggagacctggaaacaaggagatggcaggcccgggtggagtgtggcaggtagaaagaggctgcagctccagagacagccaggaggtcggtgagcaaactaaagcaacctgtttcaccagccgcaggcctggggagcgtgtggagacaggagaggtgagctccccggcagcccatggctccagcctgaggcccaggcatctgaccagagacactgatgacatccttctcagaagcagccgtcggagggggctgagcggcccttagtggggaagaatcagccgaccagggcagagggcccgacagagggagtcagacaggtagacatagagagtgggttcatctatcaaagccctcgccctcttggcaagttctgatcttcgaagtttccaacttgtagctagaaaagtggccaccttctatgccccctcccagttgggaggatgctggggtctgtgcaaatattcactctgtgggatggtacaacttggtgaccaagaacttgggctgtttgatcagaccggcatgggtttgcctccaagctccaacacatcctggctgggtgatcgtgagcaagttactgaacatctctgagcctcggtttcctcataggttaaaacagaggatcctcggccgggcgcagtggctcacgcctgtaatcccagcactctgggaggcctaggcgggcggatcacgagatcaggagatcgagaacatcctgggtaacatggtgaaaccccgtctctactaaacatacaaaaaattagctgggcatggtgatgggtgcctgtggtcccagctactcaggaggctgaggcaggagaatggcgtgaacctgggaggcaaagcttgcagtgagccgagatcgcaccactgcactccagcctgggcaacagagcgagactccatctcaagaaaaaaaaaaatagaggatcctcaacgttcacaagtaacagagatgttgagggtatagaagatggggtgggtggctgcacaagggaagcgccattatgcagtgactataagcctggggctgagcacttggcctcctcctgctgctgagggacagggcggctgtggccccctatccctacactgccccatttcttttcttattttgtttgtttgcttgtttgtttgtttattgagacagggtctctcgctctgtggcgcaggctggagtgcagtggtgcaatcgcggctcactgcaacctccacctcccaggctcaagagatcctctagcctcagccgccagagtagctgggtctacagatgaatgctaccatgcccagcttatttttgaattttttttgtcgagacaggcatctcactttgtgttgctcaggctcttctcaaactcctgggttcaagcgatcctcctgtctcagcctcccaaagtgctgggatgacaggggtgagccaccacacctgacctgccccatttcttatgcagagcacttgacatatgaggacttcttcccatgggctataagggggaaaacgatgaggctttctccttccccactcctctctggcagacccccagcacacagcccgatgcagagccaagaggtctgccccaggaaacaacccaaaaaaaccagagtgaagccaggcccaagaccccacccaaactgacgtgggacgagggactgaagtccgatcggtgttggacccaagaaccagcaccttaacccatgcctgacccccactgcctcctttcaccacgcagggtggagactgagaagcctgcagccgcctcgtccatcttgctaggaggcacagaagccaagggaacagccacacaggggaaagcttggagaaaggatgaggaggaggcaggggaagctacaatcctgggtggacacccctgaaggacaggcaaatgcccacccactcacaacatgctagacaaaaggccactttcgagtttttaacatatgcccacatctattctctctatgcagtctctctgcagaagacaatattgtctctagtgtttagatgagaggtgaagaataagcaaagatacctcttacatctccatgaaggcaagggctatttccttcacccctgtgtcctaagcttagcctagcactgtgccaggcacatagtaggtgcttaataaatgtttcttgaatgaacgagtgaaaagcaatcgtagaatgcctctgtgagttccacaagggcaaacattatgatgtattcacttgcttggatgagccatagagttcatgaataaatgtgtgaataaataaaaagagtgatagctaacattaagtgcttattacatgccaagcattgttctgagcactttaaattgattaacacatttacttctccctccggcttccccttcctacttccctcctttccattcatcaaatatctattaagcatctttattccctatgctaataataggggtccacagaaatgagcagggtgtgggaagaacccgtgagtatgaggtatatgctatcgttagttccattttacagatgaggaaactgaggctaagagaattaagttacctgcccaatgtcacacagtaagaaggatgcatacgtgggattagaacccacagtcaggctcctggtcctgtcttatgcgtgaataaggttcaaaggatgcttatcaatgaccgtggtgaaatgctccatgcttttcagcctggccagcatctatccctgcattctgtagaccagccctgtcttccttgagcaaacactccctacccgctatgtgattcaggtacttcaagcctggccaaatagcactgcaccctccagccacagtgattggcttaaggatgaatacatgaccaatccaggccaatcagcgtgaatcctgagacctcattacactacaggaaagagatgctctacctcagcaaggaggctatgagcttggggccaccggaggaagggggattaacttgccctcttttaggaagagcctggcagagaatgaagccaacaaaaacgaaagcagagacaagaacactagagagatgaactcctaaggatccggccaggcctgaaggtttatccttaagccagtttgagatgcgactctattccttgcaaatgaaagatgcctgcccaatactattattgttcagttcaacatccttctcttataaatgaaagctcagagcaggtcagtaacttagtcaagctcatagtcagtgtcaatgccaaggctagagccaagtctcacgaaaactcctctgccagtgcaacattcctcctcagtctgtctaacgaggttctccccatgccgtgatcatttctatggacccctattattaacataggaaataaggatgcttaatagatacttagtgaatggaaaggagggaagtaggaagggggagcaggagggagagggagggagactgaattcccagagatcaaaacctgttcttactcagcttggtatcaccaagtgcccagcacagtgcctgccatacagagacccctctaaaaataatcagatgtgtggcgggctgaatgcacagaacaaagcatgagtctttgctgtgccaagagaaacagagagggttccattaaatcccccaattgctaggggcactagcagtagaattggatttgtaaagctacacacatgattttgtgcctccagccctgaacacctttttggccacatggtaaaaacatcctgcctctgctcatctgcaagcagggattggaaatcatgccccccgcccctgtgctcagctgccttcaggggataccttttctttcccattcttaatacccccagacttctaagagtcaaatcccctatgccttcctctcctgcaacagacacaccacacatagaactccactggcctccaagggaaaggaagggaggccctgccctcctccatccaggaagggctctgatgccctctggccagggcaggcaccgccagccacactgagggtggaggattactcctaacagcatcttgaggtagggtagggagagccttgggaaatacttgtgagcatttccaacacacaaaatagggtctggtttcatgtgaagaaatgtctctctgcaactaagggaaaccaggcaaaatatgaccaagccttacaaatacttgtccacctagtgaagacgtgagagtgtggtcctcagaggcagcctctggctcccacatccatattccacttaccctgagacccacagccagtcccttcccctccctgggcttccattccccagttctgcaccgagcagctcaggcgaaggatccctcagcaaccttacaggttttggtttttgtttttgtttctgagacatagtctcactcttgcccaagctggagtgcggtggcgcgatctgggctcactgaagcctctgcctcacgggttcaagtgattcttgtgcctcaacctcccaagtagctggcattataggtatgcaccaccatacctggcttaatttttgtatttttattttattttattttgagacagagttttgctcttgttgcccaggctggagtgcaatggcacaatctcggctcaccgcaacctccacctcccaggttcaagtgattctcctgcctcagccttcccaagtagctgggattataggcatgcgccaccaagcccggctaattttgtatttttagtagagatggggtttctccatgtgggtcaggctggtctcgaactcccaacctcaggtgatccgcccacctcggcctcccaaagtgctgggattacaggcgttagccactgtacccagcaatttttgtatttttagtagaagcggagtttcgccatgttggccaagctggtatccaactcccgacctcaggtgatccacccacctcggcctcccaaagtgccaggattacaggcgtgagccaccgcgccaggccccttactggtttttattttgtttgttcataaagcaaaaagagtactcgctctggagcctggagagtgtggactggaatccagactagacaatttagtacaagaaggacaacagctactactgagtgcttgctctgtgccagccacactccaagctcttgcatacattattccaatgcatcctccctacaaccctgaggtgggtactattattatccccattttatagatgaggaaactgaggcacagagaccttcaggaaattcaccagagtcataaagtctgcaagtgctagggccagacgtgtgatctcagataggtttactcagcttctttgaccccagtggactcatccgtaaaatgggaacccatgcccaactctcactgttactgtgagaacccacaaagggaatgaagggagaaggcatggagccctggaactgttcttttcctttccttcctctcgcttgaatgacaaaggtcttcacgcctgctccccagcctcacaaagcaggtagaaaagtcattgcgatggtggggggtggggtagcaggctcagaattcagtgacaggcatcctcatacatggggtattattattgctgttattattgacatgaaaggctagaaggctctgatttaagtaattgggccacaccaagctctagctccaaacaaagaaagtgaaacaaggctaccagagaaggacctcataccaggggctccccatggtgccagattccaaaaacctgactccatcagccccgctctcaaggtgtttttctacctccagtggctttgggagaaggaggcccaggcccgccaggcctggctggcctctcccctagcccctttgaagtgcccagcatggggtgggctggaaggaaaaccctgggccacagaggctgtgacggcacctacccacccccacccggctacctccccctcattgtgcagcctgactgggcctttgttgccagagtcctggcgggggacagccagggacctggcctcattaagtgcctgacctcaggcaagccccccccacccagggtggaaggttaatgtggctgcccgccatgcaggcctgggcctccaggaggctcctcgaagggacaaaggaccagccccctgtctcctctccaggccccaaaacagctgccagcctgcagagcgctttcaggaggggggctggctttgatggctcagaagtcaccaggggggcctcctttccaaaccctccttcctcccaccctgtcaaggagacaaagctcacagggaatcgccggagggttgacgcaggaatgcagtccatcgtgggggaggaggctggctggtgacgggctggcccacacctttcttcgaccttccagaattccccagggctcaggaccttgcttccaagcaagactcatttcagccctcaccaaggtgggatggagtagacaggacaagtggtcagaataagtcagaagcctctcagtccctaacccaccaggtccttctgtcacctggtttctgggtacagaactgatgtcacctaaccagagatgggctgggagcagagcagctcccagaaagagagagaaggccaggaatcctgtgcaagggaacaagcacatgatgttttttaaaagtccctctggcttatcacatcaccttctaataggagggctcactccaaaatgctaattacctaccaagtaggctcctggagtccaagccaagcaccaggtagaaccacctagaaggccattcctgatcaattccctcatacaatttccagttatttggaggcctgcgtctcgtatgccagactgacacgcaggtttacagcacactgattttaatttcaaaagactctagggaaattttttggagtgttttatttgcttaagatcctggagcaaacacaggggctccctggggcacaacaggactggcccaggaagcagtaccctggaccgtgcagtgggatgggcaggagtgccagagttgtgcgttcacgcgtgtttctgcaagcaggtgtgtcccagcgtgtgcacgttgtcagtgacacaacaaaaggccagctgaaagccttacctacggtgcgggcaggcggcatgagcccgcggtgatgcgaatcagccttaaccagcccattgttggggagcaatgcctttcaagggacaaaaggcagagggggcaggaggatacacggggagaggcgggcacatctgtctgtggcatgaaccactgccccattacgccgcctttccccacagcagcatctgggggtgcgtgtgtgtgtgtgtgcagggaccagcccgactccacattgtcctgcccagccaggagatggagagtgcggcactcttacaaagacatcgattttcttccttcccttccagagcaagatcagatgagctcccggagtgacacgtccttaacttttcagtggggttttctttttctgacttgtttgtttgtaacatttttttttaaaccaggtctctaattgtgtcttttcttggctgcatctcctttgctcccgccccccgaagcaaggagggcatgtgctgattatctgagtgtgcagcctgctcacggggcatcctgggctctaagaatgccagggggttagaaactggggaggggtgggggaattaattgccaagaaaacacaaggctgtgctgcgactttgattccatcaattaccattatctttctccgcaggtccgccaaccatcccccgatccggccgtgtttaactttctttgccagtcgtgataccccgtcagatttctggcgctgccacgccgcccgcctgggctccttctgggctcttatcagcctctcccagtcagtctggcccgccacagctgttccaggccctcagcccctcactttatctgctcgcacagacctcggcctggcaagcggtgggcccggcgcctgctccacattccccaggaagccagctgggaacacagccgccctgctcccggaccctctgagagttcattaccagccagggtaccccagcccgtcagccaaggtgcgggccgcgctgccgagcccggccgccggagccgcctgcatcattaaaactccaaccttctgaagagaagaaagaacaaaaccacaaatttagattaataaagcatttgttgattctacagcaatttagcaggcctctaagaaacccaccagagacccgcggagctccagtaattttctgttatattatctttcttgtaaaatacttccccagacagagtccccaaaggggctcaaatatcactgtgactaaccaaaatcaatgtgcactcacctattgacatttttacatagtttttggatttagtatccagccgaaaacacaatcacctcctctgccaaggagccgacaggcacttagctagtcagctattagtgttacaaagggaaaaatggaagcacccaggggagctgggcgaggcggcactgacgtcagggggtaattgggtgtctgagagaaattgccagcggctggccggctcccccgggggccgcacaaagctgagctgtaactctaataaaggaaaggaaattctagaaaagggggctttgctacaaaggagcccaggcagacgccaaaaatagccctttggaaataaataaataaatgcggccaaaacatctagatctaaaaaataaaataaatcactgctccacggaagctttctggcctcgcctccctggacatctgtttgggggcgcaaaggctcctcccacaccgtcccccgccccctgcccccgttcttccctggaaccacatggattttgatgctggaaggaggtttgccatctgatttggcaaatagtatgtgttttcaaaagaatctaagtttgtcatgtcctctttcccagaggtggtatcttcattgtttactttggggctcacaaggaaaaggaatttctattgtccggcttttagttgttttgatgttttcagttttgatttgtttatttttgagtgctcttaccatgccatccccactggatgaaaattgaaggggctctggctgcctggttcaggcctccttaggaaaagtctgtgttcttgggaagtgggctaaatttttatcttacggctcttccacccactgaccctgaggccaagtgagggccaaagtctccaagagggaggaggacagaaaaatagtggaccccaccccacagcagctcccgagccagggccccaggccaggatatcagcctccctggggagtctgcagccctcagaagacaggggcgaggggctgggctagaagcagggtttcaaggccaaagaccctctgagacccagaggctgccaggaaatccaggcctccttgatcaggcagaagagggtggcttggggaaagagatggcaagaatgggattcccagggtcagattctatttcatcgctttgaaagaaaaaggaaaaagaggcccaggatttcaaaaaaaaaaaaaaaaaaaaaacaagaagaagaagaagaaaaaaagaaaaagaaaaaagcagaatgcactccaaccccaagctacttggaaattggtcggaacaaaggtcttcagctaaaaatgtcaaatcagcaccacagggctccctgccctctccgtctccaagcccctgctgaagcccacagggcctgctgggagcagaaaaggcccctcctgaggtctgctcatggcccacagccccacccatcatgacaccccaggaggcacagggcttcctgactggggcggaggggcagctggaatacagggggccgttcctttcctgatggaacatccaggattggcactggggaggaaaatcaggctggagaaaggaaagggatcctgcaactcacagcccagggaggggaagcaatgctcaggaacgcagccgccagcgccctggcaccaaatcacaaaccttgaatcaatgatgcaattgcttaattaatcagcctgctcggggtgggtgcagaggatctctgtgagcatctgacccaaccagctcctgatgggcaaacccccctccttgggccccctctgctgggcccacgggaccacagatggttgaacaccgtctgggagtctcaccaaggggggaaaatgtgagttcctgagtcccctgtgtgatccagtcactctggcagaaaggagggaggaggcaggagaaaggaggagggaggagggaagagggaggagggcagaggagggaggagaagggaggagggtcttatcagcaacttagaatttcttggccttggctgctgtaagttagctctctcaatgttattttcttgtcccagtcaatgagattgtaatagaaatagagaggcctcttttcagcaagctagtcagtgccagatttagaatgaaaaaaggcagcttaaattaaccctaaggcttaacatgtttaagtcttgtaacttttaaaaaaacagaaccaaaggtgagtgtgcaggtgatggaggctgagatgagtcacacgtggaagccggtatatgcacgtgtgcgtgcatgcgcacgtgtgtgtgtagggtgggggacaggaaggcacccctctgtcttttcaagacttcagcagcaaaatgcttgcaaaaaagtagcagccagccttgatatttcctacgctgatggccccaaccagcgacgaggatttgaaaccagttcgcacgggagattggaccatctccaaggttgattttctcatctttaatgtgcagaggggaggtgagaggaggagaggggaggggaggggagcaagtgggccaatatctcaaaccgaccccaaacggttaatgataatgagacggcagcgcgctacaggagcttaacagctctaaggaagaggggagacccaggagaggggcacggcagaggtgttttcaattaccaaaaagaaaaataatttatttttaaacaatacctcttcgacactgggtgtttaaagagaacatactctggcccctaaaatatcaaagtgagatttaaaaatagaaaagtcatttccccccttccccgttgcagattttactgtagcgttctagaaggcagattaaatgaaggaagctcaaacacactcaattttgtcctttagcaaattcttctctttcactcttgcatgaagaaaaaaaatctccccacagagtttttctcttcttcctggtgtggatctgggcccctgcagtgccctgtgtaatttccagttcctcagaattcaggtattaataaagaccccatggggacttccaacaatataaccctacattttgaggcattatgaaaggaaacccccaggggtctgtggctcaaatttctgaaatgtaggcattgtaaaaggcaccccaggggatgcccgcaatagaaatctgctgaattcaaagcattttggaagtcctggtgggagtcattactcccactggaagctttttacaaaacatgtgttgctgacatgttgacagattgctcagtgaagtgtttaggtgcatgcacaaggcgggcctttggagacgctcacactgccagcgagtctctgaacgctggaaccggtaccatccatatttcataacaggggaggccaaggcagccagggacgggagaagtgttctccaaatcagcagcgagcctcgcacccctctgccgaggagccacttcgagtgggccagccccatcctcgcctttggaagctggtttgtgcagcacagctgtgacggcccttgtatccctgccgagggctttactgaaggaatcttgaggcgacctcactgatcactgcaaggcgtcatgccgatcaaattgaggagggggcagggtggaggcggggggctggcgggcccctcacctccacccccagccctcaaggagaggctggatggcgggagggggtcagaacaaggggcacgcttggtcttgacagcattaagctcaagaaagtgatctgtgactttaataaggctgagaggctccgaggaattagctgcctaggtgatgggggccagagatggatggaaatgtattcatggcctggtgggccaagggccaggctggggccctggggaggctggctcacccacagccccacacgcttccaagctctcatctccaaaggagtttctcggccacagacccatgtgtgctggaggagcgagtgccaagccaacctgcctgtgtgcacacgcacacacacacacacacacacacacacacacacacacacactccatggcaggataaagcaccatatgctcatgttcataaaattttaaaggtaaaagcagatgtaatttgataaatgtgtacatgtgttgatacgaacacatgcaccaacacaggcgcgcaggcatgcacacgcccgcattccaatgctgggccctcctccctcctgggctctgcggttaccgctagaacctccccacaggtgcaccaggaccagagaggcgacctgcttaaccgtgtcatggccgctggaacacacaaagaaatctcctttagaaatttctttcttgaaaacatttattctttttgaactgtactctatccattacgtcagcttggggttttccttcattgaattttttttaaagcatgtgaaggagtaaaaatcatttctgacttcaatttaatttttaggcacaacggcatttagagtcagggatggggtgggggtttcccagggcagggtgcccatccacccagccctacatttttcagggactttacctgcaggctggaaatttactctggatctgggaccagaatcctatcctcaacctggtggcccttcctgtctttttcctcctttcaggagaaaattacatttcaatggacaaatggctcttcctagagaagggtgcaagattccactctcccaaggcccctcacagacttctagggacaaaggctccagagaggcacctagcaggggagccccatggggtcagcccagggaggcccagcaagggtggatccggctctgctgacttaatggattccttcccaccagctgtcctgggtgagaagctgctaaggcttctggagctggctggctcctaggtcgccctaactcgctgggctggcaggggttgtttatctcccagctcctctatgccccaccctgggttcaatgcatcaccagcttgtgcccagcccagtgcccggcacataagagatgaacaggagccctgtggtgagtgaagaggtgagtgaagcaactgatgagtgatgcgcccaggccataaataaaagccatttaagtctaccccagtagactccattcagtgcaagggaggaagggcaggtttccccttcagagtggacttcagagaaccctgttcttcaaagagggcctggaggcagaaagggatgactgagcccgggtctcagggatccactttccagagggcagtcttagcccctctggaacaccctggctgtgccatagccagagggggaacacaggagcaggggcataaagaactgaaaaggagaagggaagaatcttcgctagaacccccttctagggcatctcaactccactccatgacactccacgaaaactcccactaagcatgccacacctataacaggaaatccagaggtgacctccctcctctgggtccctcagtcctacccacagggctctgacacctttctccttggatgacagtaacccagtgaccaacttgtcccaatttgtctaggacttccccaattttagaactgaaaatgctacatacataccaggaagcccattagtcagtcagtcatgagcaaactgggatagctgtaccctcacccccaagactgtgagctctgtgagagcaggaaccagcatagagcctgatagagaggaagatgcagtgaacatttgcttactccatgcatgcatgcttgaataaatgaaggctttgttcccaggctccagtagatctggagggagtatgaaggtttgtgtctcatcacacacagaggacagaattccactcccatgtaactgctatgcagagcacacacacacaccagactcccaaacaccacagtgccacctcagctgcactgtgggccttcaaatatggctgccagagcttggaaccaggcatgaaaacttcccagctccaagggacctccacttccaactggagtctctcctgctcatcagcagccccaggccacctagaactccctgggctccctcctggcctggaagccacttacaaacctgtgccaacactgccacctccaggaggccaccctttgcacccactcctgcctagcccttccagcctctttgttgcccgagctattggcctgcacttttaaaggttaaatgacagcacggtgggctgtcctgtcttctttctgggaaaaaggtgggagggcacttgggatgggagaataagaaggccttaaatacaggcttatctggtacatcaggagacagatgtgaatgcaggagaattcattcattcaacagagtcaaggccccagcccttcacaaagcctgccatggtcacagcatggcaggtggatcactgggatggggagtgccctctgtctagctatagggcactgtaatacacacctgagcacaacctcacaatggaacagtataaagccgattaaaaggaggcttttggacaatattaatatgataagctgtttacaacctatgggtaaacaaaaacaaagcagattgcagaacaagaatgtggatggatgaatgccaaaatgactctctggatctctaggttataactggattttcttcttttcacttctctgtacttaatagaccttccacagtgagtttattttattttttgtgcgtgattttgagacagagtttcactcttgttgcccaggctagagtgcagtggtgcgatctaggctcactgcaacctctacctccctggttcaagcgattctcctgcctcagcctcccaagtagctgggattacaggtgcccaccaccacgccaggctaatctttgtctttttagtagagatggggtttcgccatgttggctgggctggtcttgaactcctgacctcaggtgacccacccaccttggcctcccaaagtgctgggattacaggcatgagccactgcgcccggccccacagtaagtttatatagcaagcataaaacaagaaaaatgtattttgagaaacaagggagtgtccaagtgctccattgcttctgggaaccccagagaaggcacgtggacgaccatctgtgtagaggtcaggaaaggcttccaggaagactggaaggatgggatggctttacagggaggcacactgcggggtggtgtttaacgcagagagaacagcgtgggcaagggcaccacacacttcaaaggcaagggtgaggtggggagtggtaagatagcctggaaaatagggccagacatgaccacaaatggccaccctaggaaaaaaaatgaattttggtctcatgggcactggaggctgtcagtcctcagaactgacccctcaccactccccatcaaaggtgaagccagtttgccttgaagaactagtttccatttaacaattggaccctccgtaagatgggcaggactgtagtcccaaaaggatagagccttcaagttctcacctccaggccagccatggccacagctgcctggccaatcagacagacacgctggaagaatcccatccctgggtaccagcattgaccctccagtcctgtgctctaaagggggctcactgccttgtggggaccagggcatgctgccccaccattcacaacagagccaggtgtgaactgggcccagggccactccaccgcctggaggcagacttccagccactggtgggatggctgccaccaaacacagaatccaggtgtcagaaggaaattaaaacaaatgaccctgccacattttttatcatccattcataaaaaatacaagagcaacatggaagaaaaataggtcacttcagtgagatttacagcaacttagagatctaaacatcacccgaaggtcttctgcctccatctggcttcaaaaggccaggtctgattgacccagaaacagaagagaaagtccagaacccagacaaagtgaggtaatggctccgggcaccaacaacacaagggcaccttcggcctcacatggcaggtggtcccaggacccatgactgccagccaggaaggagaaacctataaacaaacccccaggacaacccacacacctgcccatgctatccacagcagccagagggatctgttaaacacacacaccggatcctgtcacccttctgctgacctcttccaatggcttcccactaggcttggaataaaatccccacccctttccatggcctgcgaggcactatgtgatctggccccagccccatgccatgccctcacctcaccgctccctgggtacctacccccggggtccctgccggtaccccgacgccctgtgtcacctctgcttccccagggcctttgcacatgctctccccactgtctgcagtactctccccactaggctccacccacttacctcttgctcctctcagacccagggtcaagatgtggggagaacctatatacagaaaagagcatttgtcaggcatggtggctcacgcctgtaatcctagcactttgggaggccaaggcgggtggatcacctgaggtcagaagttaaagaccagcttggtcaacatcttgaaaccccgtctctaataaaaatgttaaaaaaaatagccaggtatggtggcaggcgcttgtaatcccagctactcgggaggctgaggcaggagaatcatttgaacccaggagggggaggttgtagtgagccgagaccacgccattgcactccagcctgggcgacagagtgagactgtctcaaaaaaaaaaaaaaaaacaaagagcactttccctactcataattcaaaataaaaaacactaaattataaaataactataaagaagccttgataaaatttacgtattatttacttatgcatcctctaatgctttaaaaaaaaatactagtgccctaagcacttccttgcagatttgcagatcttattttacttacttatttatttatttatttttttgagacagagtttagctctgtcacgcaggctaatgtgcaatggtgcgatcttggctcaccgcaacctccacctcccaggttcaagcgattctatgattcagccttaaaaaagaaggcgggctgggactgagctcatgagggcctgcagagtggagacttaaatccaaggtcagggcaaaacatctggagttcattgccaggactgtgatgttacagaaaaggaccgtgaaaggtgcgtgcgggacccaacacagaatcgtggccatgaatgggctcgctgaggacattcgacatcagcggtgccatgagaagccatgccaccagcaacaggggaaagctacggaacctgccggcagatctacagcatggagatggctccaaagatcaacctcttggtggaaaagaactggctggatcggcggagctgctgagcctgtggatacgacacccaccacttttttcttttcttttttttttcttttttgaggtagagtcttactctgcccccctggctagagtgtagcggcaagatctcagcccactgcaacctctgtctccagggttcaaccgcctcagcctccccagtagctgggattacaggtgtgtgccaccatgtccagctaattttttttgtatttttagtagagatgtggtttcaccatgttggccaggctggtctcaaactcctaacctcaagtgatctgcccgtctcggcttcccaaagtgctgagattacaggcatgagccaccatgccctgctcttccttgcagaacttagctccaactctaccacctcagggacccctccccgacatcctccactgcccacatgccacagggacccaacacgtgctacccgcacagcctttcacaggccatggatgtaccttcccctagaagcacttgcggaggctgtcattttcccactgcttgtctgattcttggactaatgtctgttccccccagcacaccctcagctccacagtgaggacaatgcctgcctcctcctgcttcagcacagggcatgggacctagtaggtgctcagtaaatatttgttgaatgaatgaatgaactaataaccccatgaatgaatgggcggggggtaaagattcacattacaaacttgctcttcagtgaaacagaaagatccatcactgagctcctgggaagagctgatttccctaaggaattcaaatagttatttcagcaaacatttacaagacacctactatgtaccaggccctgaggacataaggatgaacaagacaggccttatcctccagcagctcggcccagaaaagacaaacgcataaaaaactcaaacgttcagcagccgtttatatatatatatatgaaaacggagcttcggagccctgggggaaagccaaggaaacaaagctgacttcagaagcaccatcatttcctgcctcttgtctcccccaaccatccctcgaggtcaggacgctgctgttctcagcaggtgccaccctgctcggtgtaacagaggcacacaaatctgactcttccctgaagcaggggttcttcacaatgacatcatcttagtgcccgagaggctgccttttttcatggaagacacgtttatcaggttcctacaccacgccaggtacgatgccagccactccaggtatggaaacgagaccatggtccccgccctcaacaaggggtgcatctagttcagcagctctcagccaggggcagcaaccgcccttcaggagcatttttcaagtgccactgctatcgtctgaatgtttacgtccccccaaaatttgtatgttgaaacctaaccaagatgatggtattaagaagtggggcttttggcgggtgattaggtcatgagggttccatccctacgagtgcgatcagtttccttatcaaaaagccccaacatagcttattagtccctttttgcccttgcaccagagggcacatagaagtctccatctatgaggagtgggcccttaccagacacggaatctcctggcaccttgattttggacttcccagcctccaggactgtgaacgacaaatttctgttgcatgtaaatcacacaatcagtctcagatattttgttatagcagccagagcggactgaggcagccacaataatcagggaggttgctactggcatctagtgggcaatgccaaggatgctgaatgtcttgccaagcaaggaacagtcctcagaatgaagaattatgctccactacatgccacatgtagaacagttgaaactctagaacaaatctatcagcctaaaataaaccaacaaactctcccttgacttgcacacagttgctagagatagcgagccaaaagtacaaataacaataatgacaataatctatagtccgaagaggtgacctgctcgtcatgtctagttttggaccctaaaacacctcagctctcaccaaaattcttcttccacacttcccaggtcctccctgcctccatagttggcctatccttcctaaagtccttgctactccggtgtggttcagtagcatctgcatccccagggagtttgtaagaaatgtagactctccggcaccccaggtctgttcaaatggaactgcattttcataagattccaagtgatcataaggacctaaacgcctaagaagcactgcctgaagtcacttcagggccgactctggcactttctgctcaaaagtcaccaggcggcagaagtagtgagggagactccatccctgcatcctctccatccccggcatcctggtgagatggcacagcacctctgtgcagagcagccgggtgccactggaatgacaggtggctcttaatggtgggaaaacaagagaggggactccacaaaaagtcaaacaggtgtccagccttaaggaacccacctggggaagattctcatttaagctccataccagtcaagaggtgacaacacgtggcaatgctaaggaacactgtttaattcccgaggggcttgccagcctgagaggacccagaatgagtgtaaaatgaggttgcaatgtctccctcagcaccagacaacacctgtgccccacccccaggcttcacttggggacatggggctcagatccaagtcttatttcagggtttctctcccagctgcaccagaagctgccgggtaggcaggtactgactcccctctgtgggcccctcaagcacagtatgtaaagccaagttggtactagggtgacgactgtggaacggggtgagatgggatgggatgggacaggataggatggaatgagaggggtggaatgggatgagtagagcaggtgggataaaataagatgcaatggaacagaatgttggaatgaaggaaagagaaggttacagaggctgggcccaacgatgccccttctccttatcaaccatggaaaaaagtgttcctacagggagacgtgtacaagaatgtttactatagtgaacaactggaaacaccctaaataccccccaccaggggcctgctgcataaagcacggggcatccacactacgcaagccccacagcagctaataagaagtagggagatgtacccgctgaggtgagaagctctctgaggtctaatactaaatggaaaaaaagcaagttgcagaatgatagatccaatatggtatcattcattttttaatcaaaaatcaatataacattgtttctgtggatacacataacactatatttcactgaacgtaagacaccgtggatggtaaaatgcaccattattttacagaccactgaaaaagaaaaacaaaacccactgtcaattaaaccatgacaagccactagttgaaagatgcacctcaatttcagaaatgttaaaatgtgtcttagaatctatgaaatacagtattacgtaaaggtgtaggagaaggtctggaatcaagaaagccaaaatggtaataacagtagttaacaagggggtggggacagcctgaagcctatctttgaaatttttacaaacagaatacatttatggccagacgcagtagctcatgcctctaatcccaacactttgggaggctgaggcaggaggatggcttgagcccaggagttcaagagcagccctgggcaacacacggtgagacctcgtctctagaaaaaataaataaataatttaaaaattagccagaaatggggccacatgcctgcagtcccagacacctgggaggctgaggcaggagaatcgcttgagcccaggaggctgcagtgagctatgttcacaccactgtactccagcctgggcaacagagcgagaccctgtcgctatttaaaaaaataataataataaagaatacatttatgtattactgtgatatttgatcacatttaattgttttaaaataatgagggaaggccttctctgctcctcacttggaggcaaagtgatgctgataacataggggcctgcattggtcacagaaggaacgggcgcccgcactgctaatgcacggtggggctcgcgtgcctgagcaggtggggtgccgcaaagctttgtgaagaggagaaaaaaagctcttaggaatgtccagaggggaaagtgccattggaaaaaaaagaaacaatagaaagagaatttgatttcgggaaacaaacaattcataatccactgatagagggctactcaggggctgagggttggcccccaaaacagctccttcatctcccctcactgccctctgcaaaagcagtttggaaagtcataatgccatcctgaatgcatccctcgctagggacctcctcagactcaagcttctaattccaccttaatatccaattctgtgtgtcagggacggctgaacctcggcctgcagccgccacatcaccttgccctgcacacaaataaaaatagctttggtgctcagagcaccggttcccttgtcttatcctctgggggtcccgggagcggcgcgatccgcgagtggaaaccacgtgtgatggaaatacataatgaacaaagaggctccgcggatgcatccttgaccttcctgcttttccttgacctctccactgccattgtccctatgaagccacaaacagaatgacaccgtcgtgcaggtgacagccacagaatgccttccattgccaatttctccaggagttaagcagaaaatggatttaatcagaatgataactgattcatgtcgccatttatgcaaataaagttttggcagctcaggcctccatttgtacacctccacttgccaggcgctgggcctccagtctgacaaatctgctcctctgctccatcatctgtggccttacagagcaagaccaaagtgctggcaattggcttgtcccaggaaaagggaccaccaaaagctaaaagcccacagtcacctgacatagcctcagggtccaggagaaacagggcaccacccactcccccacacaaatcacacaggaaactgctataaactggggctgatctccaaaatctgacttctgagcatttgctcatccgcaggatctaagagagcccagggagtggggtgggtacaaaggatatttgccactgtcccctctagatccgcccccaccttggtccattcctgctctgtgttcctgcagcgactgcagtgggggaggagacagatttggggtagttattctcccagcctctgccctgccctgctgcacccctctccctcagcagcctccctacagccagtctctccaggtggcctaaatgcccctccccgcaccctggcaggttctcaggatgatgccccactcctggacagctccccttcttcccctgcccgcttctgcaaatgggccctttattaaatgctcctccatctcccggtttgagtgcgccatctgttttctgttgggaccctgaccaagggggtattctttaaagaatttttaagtaaatatgtctgcaaggtgtttgttgagactgtgataaaaaggcattcgaggaagcagtgtgaaagatgccatccgtgagactggagagacagaaagtcagtgatcagacacgcaggcccagagaatgtgggcgaagagggaatcttccagtaactcactcccccgctgccagggcccccatccctcccctgtgatctggctgtgtggagtcaatgaccagtggctttctccctgcaactccatcacgcctcccacagggcagacaagtcagcccggcagtgtggtaaaggaaggaggagagagtgaacccaccaggcacagttgcttctgaagcccagctctgggtctcttgcttaacgccccagcagtgcttctcaaatcccatccccaggagccggagcatcttcctgtgccctgcagacggctcattctcccaggagatcatgggctccgaagggcgggagccaattgtatttattcatcacctcacacatgatggtatgacggtatgacgaagcacccggtgcttacctccttattatctgtttccccaaccagggcagggatctggtctactcagggtgctgctatatttcaacacgcagccagggcctagtacatactaggagctaaattaaaaactgatggggccaggtgcggtggctcacacctgtaatcccagcactttgggaggccaaggtgagcagatcacctgaggtcacgagttcaagaccagcctggccaacatggcaaaaccccatctctactaaaaatacaaaaaattagccaggtgtctgtaatcccagctacttgggaggctgaagcaggaaaattgcttgagcccgggaggtggaggttgcagtgagccaagatctcgccactgcactccagcctgggagaaaaaaaaaaaaaactgatgaggccgggtgcaatggctcacacctgtaatcccaacactttgggaggctgagatgggtggattgcttgagttccagatcagcctaagcaacatagtgaaaccccatctctacaaaaaaaaaattaatttaaaaataaaaatgggtggtctgaaatatgaactgccccctccactgaagaccgaaatgcaccctggggtttgtcccgcggcccctgctctccagcccccaggaagccatgggaagagccatttctggaatgggaagggaggtgtgagttgggtgtggcttggtggaatttgaggaggggaaggcttctttccagtcccgaggagacggcccagctgcaagcccccaagaattcctggtgttcgtgccatccaagggaacaacttagcaccacccaggccacttccaacaaatcactgagtaagtattccctgagcatttactatgcaccaggtctgccacaaggccagagacaggaacaggcatgagggagacagcacaggacgggactcctaagagggtcaccttcgagtggcagagacaataattcaaaaacatcaagcaatcactgccataaaggaaataaatggtgtgatgtgtttggcgttgaagggagccgctgctgcaggagacgggggagggtgtcagcaaggagggccgcgctgaggaggtgaccttggagacacagaaggaagtgagagagctatccacgtgaaaagctgaaagaacacccggggaaggcaggtggtgcaaaggccctgcagtggaatgagcacggcctgttgacggctcaagaggaggaactgaggccgggcacggcagctggcacaagtatcccagtgctttgggaggccaaggcaggaggagtacttgaggccaggagtctgagactagcctgggtaacttaccaagaccacattttttcaaaattaatataaaatacttagctgggcatggtggtgtgcacccatagtcctagctactggggaggctgaggtgggaagatggcttgagcccaggagttcaaggctccagtgagcaacaatcgtgccagtgccctccagcctgggtgacagagtgagaccctgtctcccaacaacaaaagccagacacagtggctcacacctgtaatcccaatactttgagtagctgaggcaggaggaatttttgaggccaggagttcaagaccaacctgggcagcatagagagaccccatgtatgcaaaaaatcaaaaaagtagctgggcacagtggggcatggtggtgcaagcctatagtcccagctactcgggaggctgaggtggaaggattgcttgagcccaggaggtcgatgctgcagtgagctgtgataatcaagcaggaggaggagaagccgcaagaggcacagggccaggcaggggagtggattcatccccagggcagtgggggaggagcagagtcagatgcaagctgtcctgaggacagcggagggcagttgaggagaaaaggctgggtacaggctgggtgcccacaggcagatgccagccattgcccctcccaagtctccctgctgcctgcccctcagccaccttccttccacctacctcccacaacacaccccaccaaccctcagaggggtcagacccgctccagcagatctgacctcatcacccccatcatgaggcagcaccaacctgctcagccaagcccttggagaggctgagacactccatatccaagggcggggacagaggtgcaggtgtgctcccccaagctggctgccattcccccacctgcagagccacctcgcctgcctcagtcttcccacatgcaccctcatacccatgacgtcatttccaaaggcagccaaatcctagccagtcaactccaaaataaaactgtttaacacaaaatgaagcattttataatcccctgtacattttttctctgagttggcacagagtgtttaaaaacactgccaaaacactcaaccaatagtagcgctttattttagaccagtgccagagttaaatttccttgctcttttcctgttccgaatcccccgcctctccctgctccccggcttttgctgcgacactagaagcagttcctcctgatcgcccctctgagccactaggccagtgggctggggtgctggggaggctgtgaccagaggaaagtggaatccgcattacgggatgatctgctgggagcactccttgacctgcaagccccagtcagcgggagataaatttggttggtttctcattttgtttggggatgttctttatttttctgtattagggtgtcatgttagggatgtcaatcacaggatctcaaggtttgaaggaacctgataaatccacatgcccatctctcagccccaagcctgcatcccactctcctcccccgccaccctctgatgtgttcatctccaggcttgcaaagactctcaccaaccaaaacatcactccttacacataggccaggcaggtgtccctggggacttctggaattggtcctggtctggcccttggagtatcaacattaatggagaaaggggtggacaggtctcatccccactcccccactgccctggcacacagaggcatcttacccagaggcaataataaaagcatcagccactcaagccataccttcaccatcataggaacaggcccccatggaactggtagggctggctggacttccagccaagctcttgcctacccctcagttcaggaggtcaggtcacctgctgtctaggttaaatggcctcagctccttctctcttcaggctgcttctgcggccagcatccatccccacttcttctgctagcagcaccctgatttcctctggggaaacttttcaggtctgctattcagagcacttgacttgacctgagccaaaagccatcatggcattcctcagagccaggagatgcaggaagactgggtccttcgcccttcactggagtccctggattcagctgcacctgaagatagtcctacacctaggtttctatttacatgagccaatacattgcactgtttgatttcagctggttaggatttggttgtctgacactggtcggcagggaatcccaaccttccaacttgcaagcatgaccctgagatctctccttctctgtcctccctgaaccactccctccagcaacacacagaacagacactctttctgcttctgctgacatagcgtcagagcacagtaaataaccctttggcagtgaaccggctcctgttcttcatttccacaccactcatgcacacattggccagtactgaactactggactaccccacagagggaggggaccaaccaactcataggagtacattcaagaatcccctggccaaagttatcgaggggcccagtaagctacacaagggcaggaactgttgtctgttttgctcacccagtgctcacccagtgttttgctcacccagttcccagcacacagtagatgcttttaaaaaaagcctctgtggctgggtgtggtggctcacacctgtaatctcagtactttgggaggccaaggtgggaggatcacctgagtcatgagttcaagaccagcctggccaacatggtaaaaccccttcctactaaaaatacaaaaattagctgggtgtggtaatcccagctactcaggaggctgaggcaggagaattgcttgaaccaaggaggtggaggctgcagtgagccgagattatgccactgcactccagtctgggtgacagagtgatactctgtctcaaaaataaaagatctgtgaatgaacgcacacgtgccaggggatgctgtggttctaaggaacacacttctctttcatccgttaagtttgcttgttcctttgagtgcctggaattgtggagtaaggaatggaagaagagagcatcaacacttttcagctctgtcttaagtctgttcaggctcatataacaacaataccagaaactggatggcttctaaaccacaaatgtttattgctcacagttctggaggccgggaagtccaagatcaaggtgctgggagattctgtgtctggtgagggcgcatttctcatagacaacacagtcttgctgcgtcctcacatggtggaaggagctgggcagtcctctgggtccccttttgtaagagcactcatcccattcttccagagccttcatgacctaatcacctcctacaggcccactgcttaatactaccacattggggattagatttcaacaaacgaatttgggggaaaagcaaacattcagaccatagccagttataataaaggactcttctagaacaactcccctctatttgcctcttttaccccaaaatcaggtcaggatcccagctggaggctattcctatcctcacccacaggcatttctcaaagcttttgcaaacctcaaattggtagtaaccgagattgattactcagggaacacaattttcagatctttatgcccaacagaatccagaattagcacaagcacctccaggagaaaggcagcagggcctctctggggggctctggcctttgcttttcccgcccaggggtgagacagaggataaggagggcaggaagtgccggcctaatgaaaaagcagacctgacgggaaaggaagagcagctccacgtgacgggccctgagctggctcagtgacactgaggttttagagctatacactaatacactgggggaaaaaacttattattgaaatatctacagaataaagaaaagaccttgttagtgcaattttagaatacgtagctgcatccctctttctccctctggctgatggcaaatgatgtggttttttggtaacacttgggtgatatagtctggctctgtgtccccacccaaatctcatgtggaattgtaattcccagtgttggggaaggggcctggtgagaggtgattagatcatgggggcagatttcccccttgctgtgctggtgatgagtgagtctcacaagatgtggttgtttaaaagtgtgtggcacctccccctcaccctatctctcctgattcaccatgctatgatgtccttgctaccccttcaccttccgccatgatcgtaagtttcctgaggcctcccagccatgctgcctgtacagcctgaggaaatgcaagtcaattaaaaacctcttttcttcatcaattacccagtctcaggtagttctttatagcagtgtgaaaatgaactaatatactgggtttctcaggaacgcacgagagaggttcagcatagctggctgatttcagagttgcctctcaacaccatctgggcacctgagccactcaggctcaaggctccgactaacttggtggctgcccagcctctctccagcctggcctgagacctgaacataatattgtaggggccaagccgctggtggatgccacgagggcttgacacaccattaccccaccttccacctcccagagcactgcccccaaaggaccaagcagcagaggttcagggggaccatggctttatggaacacccaaggtgggggcacaacttctatgaagtttgttagaattcaagggtcaaagtcactcttccacaagatgcaaacaaagaaaaggtccagtgcaaacagtgtgaggtccgtgggtctggagacctcaaagacagtgagctcgatgtggcattcccagaagcacccatgagccaggcaggagctgcatatacacgggcacctcctgccagaaaacatgggtgccctgcaggctgcactagtcccctgtccaccctgggagctgcaatcccaccccccaccagcagttagcagataacctcagagagtgctggctaagctaccacctccctgtgtgacctgggacaagtactacctcactaaggagcctggtccagtcagtgccctggctgtgtttgagagactggttctgccattgtttcaaccacattcaaaccaaaaaaggtttgaggatatacacaccaaggattctgcttccctaaaattctaagattacctgactagacactgtcaaaagcaaaagtattggttatcaattgataactgatacctgacaatctggcatttcattgcactcttttactacttcctgtttgtctgcatgtaattcctacctcctaaagaagatgtctgtggctcctgaccaccattcaggggagcccctccccagctctcaggcccagtggtctgcatggagctgccctgattccccgcacccaaccctgacccttgctaacatgtatgttgtctccctggccgcatcatgggcgggggtgagtcttggtcctggccattctacagagtcaacctcaggacttctaccctggcaatggtaagaggctgctcattccattgtcactgctgagtcgaaaaggtggagcctggaggtgctggggcacctctgctgatgtacacacggtgatggggttcatgtcaacagacatggggcagtgtctctggaggccctggaggaccaagcttgaggccagccttacatctgcatttctcagttcctggagccaatgaatcctctattttctgcttgtcaatttgagccaagtctctatgcagatagcacattaactgaggaccaactatgtgctggcagccaaaaggatcacagcaacttcatcctccagctagactatacatttcccttaacgggaatgaatgaacacccatgcacaggcattcacggccccgaatacacagcaggtatggtatcactgcttgctgacaggtgccctctggaaactcccaagatgaaatggacaacagcaggctggacccagaccacaccgggaacacatgtacaaccagcctaaaggccagtttggtgtacatcctgggcccaggaggacaccggaagctttggctgctgccaggaaggtaacagaaaccggggacagcccacctcgctccccaagaaccatctccagaatcaacccccaggctcatcccaggggctttgtacagcagcaacacccatcgtgccaggcgccacactggatcccactctggcgcacccttggaaaccaaagaatccaagaagctcaattattcagaaaatcatgaaggtggtcaagcaggctgggtaggaaagaagcaaaaacctcctccactttggagagtcctcaaaacctccagaaagacacatagactgtagacacatagacacggtctatgccttttttcccatggaaaacacaagaaatgcagaatcttcccaccttgacccctgccttctatattgttaatttgtcatccaattttggggaggtttacaggcccaacagtgtgataacagcattcgctctatgtaatcaagtcaagggagggatgctctgcaacctgcggacttcgcaggcggtgaataaaaatgtcagcaactaagaaacaagtccccaccaccaccacattaccaccaggaaggaacccaagacacagctgtctgagccaagactcagaaccaccgtctatgcagcctgctggttccccagcttactccggatggttccccatcagaagccatcggagggcagggggcaggcaatttagggaaggcttccacaaatgccaccagccaagcagacccaggctggccggtggtccaccctgcccatccacttccctcccaagtggaagcctgctagcaggtcagcatcttcctgagagctatagagaataacgtctctgttcatcaaagcccctcttaaggacactagagaaggaggctgtttaaagaccaccacagcacttcatcacacaagtcaaagcatccttttgtgaagtgaacaccttctccactgagctaccttttataatagcctccacatccctagagcccagagggtccctgctaatagcacacactaaagaaacacttattgtatgaacgaaccatctcttccatctctaaacttacccttctgattatacattaattgaggacctactatgtccagaacttctgttttttctatctcatatcccaaagcactgtatccatggcatttccacttttcttactgcacacacccctttgccttgcaggagggctgtagcctccttagccccaagaacaaacattccttgagcacctactatgtgttctagccacaggccaaagcaatcctgcggagagggaagagaataagaccccaagcctggacatcatggaacacaacctgaccagtgagatggtgttggcaaactttttgatctgtgccattctggtatttttaaaatggtatttccttatggtttaaatttgcagttcccttactataaacggggttctaattttttttttttttttttttgagactgagtgtcactctgtcgcccaggctggaatgcagtggtgtgatctcggctcactgcaagctccgcctcctgggttcatgccattctcctgcctcagcctcccgagtagctgggactacaggcacccgccaccacgcccggctaattttttgtattttcagtagagacggggtttcactgtgttagccaggatggtttcaatctcctgacctcgtgatccgcctgcctcggcctcccaataaatattttttaaatatttaggatcccactagtatttctttctctggttccatttctgtccatttctgtagtttgcacatgggagatattcaaaacatctaaccaccagtgtggcaccaatggatcagagacggtacagaccttggggaaggccaggcatctcaagcaggcttggctgtgcctcaacctagcctttgccatgtttttttgtgttgatttattggctattttcttagcatttgtaggagttccttacacattaaggaaaacatcttttgcctgtgatatgtgtccctggcttgatttactgtggttttcacaatgtagaatttttttatttttatgtagttgaatgttttgactttggttttatggcttctgacactggggttatatttagaaaggccttcctcactctgatactattgaattaaaatatttaaaagctctctgttttcttttagtattttaaagttttctttttatgtttagattcctgatccacttgggattgagtttggtgtcaggagtgagggaaggatccaatttcctttttgggggatggccaccttttcatcctaatcccagttgctgagagagccatctgtcctccactgtcgtgcagggacacccttctcatacactagatttccagttgtatttgggtccatttctgtttcacaccacttcgaatcctttccgctccagagcaatctgagctggttcctgtccccactccctgttccttttccagaagattccttctgatgcctgcatacccactatttcttatgaactataaattcagcacatccatttctaaacaaatcttaccattgctttcattagctaacattaagccaataggttcgtttggaggaaattggcatatttatgatactgaatctttccacaagaataagagtaaggtctcttctgtgttccctgtcttccccccaccataattgattttgtttgtctgtcctctccatgccgtttgaatgtttcttactgggtttgctccctggtttttatacattttgtggctgacataacgggaccatttcttgctctgtgtttcctaactggaagctgtctgcatgcaggaaaactcttaagatagggggcggatatcaattgtgctcaagcccctagccttttgcgccatgtgaagtcaactgacaccaaggccccgagtgcattccctgtgggcagaaggagcccacacccagcacctgtgtatcaggtagcacagtgtctggcactggccccagccccacactgcacgaccaaaacagagccagttcgaggagcgccgcaagtcagtaaggcagggagcccctcatgcttttggagcaagaaaggggcctgagccagcacaaaaaggcaagcgctggccagccggccgacagcacacggctggcaaaggtgccagctccacacagcaccagccctgtaattggggcccacaggtcactctggccacagctgaacaaaccagggtgtaattaactttccacccggcttgttgcacagcagcatttcaccttcgccagaaaaggagggcctacctttcacaggggccagggaaacactctttggtcccagtcctcaagaagggatagcggagaggggagccgcaaaattaacccaccaggaacacattttttgctgttgctatttcaacaaagtcccccctcttgtttttttggaagttgagcattcaaaaaagccatctggagtttagtttgaaattgctcacagtccccaatctgtgttctcaagcacaggcaagctgttccgacctcagagcttgcctttactgacacgatctgtaaccttgagcaaggtcctccagctctctgagcctcagtcacccaattgcaaaatgaggacgaatggtagaaaatagtgcctagctttgggaggcccaggcaggaggattgcctgaggccaggaggtcatgatcaacctaggcaacatagcaagacctcatccatacaagaaaaaattaaaaatgagccaggtatggtggggcatgcctgtggtcctagctcaggaggctgaggcgggaggatcgcttgagcacaggaagtcgaggctgcagtgagctacaaatggcaccactgcactccaggctgggcaacagaacaagaccctgtctcttaaaaaactaattaattaaaaaaaatgaagacagcgtcaccttggacaccaaaggtgattgttataaagactaggtgagatgattcattcattcaacaaacatgttgaattctactctagcgctgggctagaacataacggggaacaaaacaggtatggctgttgtcctcatgcagcttaatagtagggagagagatgggtgagaaacacgtgaaagacaattacagaaagggatgggtgctctggactgtgtgggcgtgggggctgcagagggccagcagggagggctgcagggcgtgtgttccaggcagagtcccatagtgcctcgcgggcagtaggcactgaaaacacaaagaatatcaggactacagccttcactgcagtgtggaggaggcaacacctgctcacacatttgcccccagcaccagactgccagcccctggagggcagcacgcaccccatctgcttcagagccacctctctagggcccgccaggagcctggcccaactcagagatcagggaacggagctgaagggaagacaccaatgctgagctccaaactggtcctgaaggcgatttctattccaaggcaagtgcctggagcccgcagtcttactacctacaacaaaaagccatatatcaggccagcagcccctttagcaaagaggccaaagaccccaaaagctgtcaagtgctccagccccggggacctgggctggcatgttccaggactggcacagcacaggcccctgctgacagcccactgtggacactctgaggaacagcactaggaaagtcaggtctcaagcatgacagcgcagacggagcacccacacgccctccagctgccagcctcttaattcaggccaaagcaggggtcaacataaattgcagtatctctaaaagggagtatttgcaccaggaagtgaaaaatccagactacaggcccacaggtgactggcttcagtgagcacataaaaaaccaccatcaccccatgggcaaaccaaacctctcgcacctgcttctatggtaccccaggcagttcctagagaaactttctaaagcagtccaagtcctcctggctcctagaagatgatgataaacaccccctgctgcagtttaaaggacccaaatttgcttggccagcgcttcacaaattatgacgttatttgttccaacatgatttaaatcagtgagacctgaattgacagggactgcccatccttggcaattcagacagccaccaaatcctttgccatttcctgacttggtgcccacaaacaatgtctccattaggaacagagaagcccatcacacttacccagtcagcccctatctacactgtggcaaaaagcctcatctacagacatcttagtctaaatttaatattttcagagtatggacacagtacctgcaacccaagcttcctgcccttgagcactgctatttaaaagacagagttccccctagcaaaaaaaaaaaaaaaaaaaaaaaaaaatggcgaagaccaggtaaccacatgggaaccccttcataacatgttatgtgacaaacacagaacgtgaaaacgtatgtgctcacaaccccaagcatgcgaacgtgtggcatcctgtggccaggggctggagaggaacaaagaaaaatcaaacagacatcagggcgggagaatgaatggagaggactggatttttgctcttttcagtttgtgtcataaaaatgcaatgtttgatacctcatgggtttaaggttggtttctcctcagacacaaatgagagcgagagggagagagaggaacaggacttgatggagttgtccgagaccttaaagtccacgcttcaacagctcatgggcccggcatgccactcctgctgaggacaacagagaggtgccttctcgagctcccaactggaaatgaaggctccttagcacagaggccgggctccaggttggggacgggggggtcttccatcgtggccattctggcatgaagctcccctcccacccctgaggggtaagcatccccccacctcagaaaacccccaaacctcaccacagcactgtcccagattctgagggagcaaaacgctgcccccaatctccccctcaacaccaccccaactgccatagaaagatacagaagcagttttcaggaagagccacattcacggtcaccgcccacaaatacacccccgacaccccaacacacagcactctccccagaaggccaatggcttgcaagggctgaccctgccaggacacacccgtttggggaggcacgtgctgcctccacgttccagcagcaacagtccctatgaaggggagggttgttcacaccccaggtcacgattcctgagaagcaggccctctgctccaggccaagtgggcagaccctctggttcctacagaaacatctgcagggcaccatggtctgcccagcctgcgcccagcgcggccctctcggacacggtctctattgggcttctatcgagtgaccagtggtgagagtccagcagacccatcagcctggccagggggagcctgcgattgcacatttatatcagttccaaacctttaaatcagaggccaattttcaaacaacatcatctgctaaagccccaggtataaaacagacttttaaggtgaatcgctccgactggactggacatcagtgccccctcagtctgacaggccccagtactcacttcctacaccccaaacacaccacaccatagccccagagatacctctgggaacacagttcgaaaaccactgcacaatggaagggtgtggaggcattccaggtagggaactgttttgaataatacatacgcaattcccggtggtttatcccatcattgagtaatcctaagaaccgaagacctgggggaaagtaactcctcacacatctaggaaactatcccaggctgggtcatgcctttaccaggcggtaatgaatttctcagggatgcgcttaggcaaggttgtttccctcattctttcaaggaatttctgactcccttccaatgctccaggatttgggggtattcctagctcctgcgtccccacggaggtcattagcagggtcctgttaggaagcgggcaggagtgtcggtggataccaccagcatcaataaggacagctggggaccctgcaaacagggctgccatggatttcacctggagtcaaaggctgatgagagaagggtttgccactgggaggaggattcttcctggggaccaaagcacaattagctaccagttcttatttctggctcagactctcacatatagcccagtttcccagtttcctttttccacctagaagtgccaccattcttttatttatttatttattttccttttttgagatggggtctcgctctgtcacccaggccagagtgcagtggcatgatcttggctcaccgcaacctccatctcccgggttcaagcgattcttttgcctcagcctcccaagtagctgggactacaggcatgtgccatcacgcctgggtaatttttgtatttttagtagacatggggttttaccatattggccaggctggtcttggactgctgacatcgtgatccgcctgcctcagcctcccaaaatgctgggattacaggcatgagccatcgtgcccagcccgaaatgccaccattcttaaaagtgagactgaaagacaggagaatctccttgatttgaagggctggaggaaggggcagcctctaagagctgcagggactcaagaaagcacagcttagcagaaggtgtggggccctgctctaacaactacacagaatggcctattctcttgcatttagaaaataaagagaataacttttcattagatcaattagttgattataaagtaagtggcaatattttattctcttatagttaagattccatgttaattcttggctaaatcaagaaatataccaacatctataatattattcctcaagtaggatgagggtcaatagctcagtgtccagaggaggtcctagcttggccaccaaacagatatgtgaccccggccaagcaatcaccttttcctccctttgccctagtatttcccttggggaagtgaggagacttaaaaagctaacctcataggtcccttctaattctgatttagaattgaaaattaaccatcacctctgcctctggttgcaatatcacaaattccaaatgactggggtttggattactgggccccaaaatgtccaaaactgtaagattcctcttaggtctattattattattattattattattattattattattattattattttaaaaatatctgttcctccagaggttgagaatgggaacttggtctagccagccctgtgcaggcacagatgtcactagagggcaaatcatagcagttccccaaacacttaatttcaaaattccaagatgatatgaggagtagaaaaagcaagagctttgggtgccaatctaatccctaccagtaaatgttcccctcaacaagtgatgggttccctttagaatgcaggcctgagatttcaggctttcttccacaaaccagtatccaaggagcttcatcaacaaccctgatggaagaaggtctctcaggaagactgtgtaaggaacacaggtcctatggactccctctgcagatctcagagcccagaaatgtgtcatccctgtagcatggcttccacatcccagggaatgcacatgccctctgactccccaccccaatcaccccagacaaatacacatatacacacaaaactcctgaagtcttcagtagctcctagaaaactggtcttacacaccctctccaaggcaccaagtaaatggagaacagagctccagtcaaatctagcagaagcagctcccagctacccttctcctcctactcagagaagtgtgaggtcaagcacagagttggaaacaggtccctttttcacgggctgtccttggcctttgaaatttcctcatcccatcagaagctctgcctcggagcttactcctttatgcagctttccacacttaagctgcttaactttgcactaacaacctcttaattactgcgtttccaaaaggccttccagaaattcagggtgcacatccacccattcatggcctgagtaccagagcacagcttgcggggagagggggccgggacagagcaccaccatctaattcctgcctgccggaaagctgttgcttttatttttaattgtatttaaaaggcggatacagggtacccaagacaccacaataaaatgacattaactgtaaaattacattattaattctttaatctcacttgaggcttcaagctgttgctatgtccaattacccgtgtaaccacctgtcagagtcctggggctgttttgcattacctccaggacagcggtgggcccggtggtccgtcaggtctgccagagactcgaagtcctgctgacagtgatcgcaggtgtaaattgattcatcctccatgtcttcatcatcctcatttctctcctcttgacttgtcacgctgttcctgtcttccagcgcacggctggttttctgatcgcactctggctctccttctaggcctcctgccaacaggaagaatacagtccatgtcagctgatggggtcttgggaaagggttttaaaagaatcgcccggcatttattaagatacatttaattactctacctcccggggtccattatccttgacacctctcagtatattaatagatggggtttttttgtagcatgtggtgccataattctcaaccagattctttaattcttggtgcaaatcttctagggggatttcctgtcatctcccctctgtgcacggatgctgggggccgtgacccatcggagaggtgaaaaaccttatttgtctcctaaaaaccagattcagttacacacctttttaaagcctccatcagctgttcctaacacacctaaacttttagttttccccacagccttgcaatttagagctgggagatctcttagccaagttcgccttccacacaacaggcctcccagggcagtgacgttggctcagttctttgcaaagatgtccaactctgaaataaaggaagtacacatgtttgaagaaccatggatggtcgaatctcaagcttaaaatgcatccaggctgggcatggaatctcacacctataatcctagcactctgagagaccaaggtgggaaaattgctgaaggcctggagtttgagaccggcctgggcaatatagcaagactctatctctacaaaaaaaaaaaaatttttttttaattagcctggtatagtggtgtgtgcctgtagttctacctactcaggaggattgctagagaccaggagttcgaggttacggggaactatgatcgtgccactgtactccagcctgggcctggaccctatctctaaaaaatataaaataaaataaatagtgtcacctgtgacctggtacaggcctagacagttagaatcagtcgtggaatgatctcactgatttctttaaaataaaacagctactgtgcttagcactgtgcagagagtggctaatctatagggaaaagtgaattcgtaatcataatgatgccttgcaattgtgctgtgttccgtgcttcttcaaagccaccattatatatgcacagccccatttcacagtcttgcatatcctaaactcaaagaaggctcaaaggatcatgtgatccaaccccctgcagagagggacagctttgtctcacaggtaaggtacctggcatccaaccagaagaagcaacagcccaagcaccctacagaggctcagctcaacttcgtgactcctggtctagttcacttccctgcacaactgtgggtaatggagcacagccccaatcttacagattaataagacacaccaggaacttgtaaatcaaagtgcaaaagcgtgtggtaaatataacccacagaatatatcagtaatcctaataaatgtcaatggataaaatttgtgtgttaaaatgcagagaccctcggattggaaaataaaagtgtgtgttgtctcttcccacagcctgtcctggaaaacagatttacccatccggaaactagctgcactgatttaaatcaaagaaagagatcttattatccataaaggtgtttttgaaagcatatgtacatatgcaaaagtgcgtgtatgtgcacctgtatgtacatgtgtgtacatgcaacatcacagttacaggaaaaggctcagtgcacaacctgcaaacccctgagggcgggcgccaaagcaagaaagacagacacgaagcaaagaatgcactcaattcaaggtggaaaccacagtcctgtgaatatttcaatttggaaacagataatgttataagggctctatttctcctgtctgcacagaacatgcccttccaagcacccgacatcaagaacctgggaacacaaatcggctcatcggagagccagctgcttccttccaaggcggggaacgttgcacgacacgccgcctggaactgcgcggaggcagtaaaaatcaatgtttccatttgtggcccatcaaaacatctctcttcttaccaattaagggatgtacagtttttaggttcttttattatcagaacgcgccaactcctggcaatacagaaatcccattaaaagtcaggcagcatatttatctcagggaatctgatctgccgctgcagtgagggtaagaaatagaaagcaaagaaatgagaaatatcatttggagccttcgatattgtaagtcatcatacaaccatggttacacagtcaagtgcccgtctccgaaattcctcgtttacagtctttccttaataaaaaaaaaatgttctgtagaaagggaaaataaaagagccataattctggctttatctactacaccgaccctccagataataagttacaatcagcaccacacttgtgctactttacttaacacacaatttaatagacatatttaaattatcccctcgttatttttttgccgtatttacttggcagcactttctataatagctcatctaatccacaactggaaccacaaacatcacaatgtatttgatctctttaaatctggtacatcctgttgactcgggagtagataaatcagaatgtcaactctcaggtttttataaggcaaaaacccataaagtcatccaagagtataaatctgttttaagcaactgtcacctcccctatggccggctactaatgggaagggagggtggctgtgcagaaagggatggagacgaaggcgagctcaggccacacaaaggcgcggacctcatcctctgggctcccaaggggtcccagcctggccctcagggaggtgacacaagacagggaagactcaggggcctgaagaagttttggggagtgggacttccctgaagacccaagggcccctctgctgattcagcagaatcaggcgctggagaacaggaaggcctccaccccaggcagggtttgcctcttgcaatgcactttcatgcccaggagtttctgaacctcaccataagacaaaagaataaatggtgttatttttccatttgcagatgagaaaactgagcctctgcaaggccacccaaagccatgccaggatcgaatctacacgttcacgtgttcattaagcagcacacctttcctgaagtccctgggcctgttggagccccaagctctccaaggcccaggaggcagaagttctaacaacagggagctccaaggacatcagacctacctggagaccgtctggggttcctcttttccaggcccacctgatcggttgctcagtaagtcctggggatggaatgattggaccttccctactccttcaacccagctccgcctgtcctgtgtgctgctctgtccagccccagaggcccctcaactggtccctgtcctgagtctggacatcacctgtgcaaactcagagaacatagggcccagaggcccagcacctggccctgccttgtgagtcccatcacaagcgctggctcatttcaatgacctgggctagaactgcagctcactggttcctccaatcaccccagagcccagtgaagcaacttcaacaggccgaggagaaggccaatggctcaatgcttttctgcagaggcctccagggctggggagggcttcccgaaaacagccggctggctcctttccctctggctcctcccctgtcctcctgggggctgtctgcagcagcatgaagacagctcgctcagggaaggcccgagccaaatggatttcaaatcagggacctctccctcagggccatgtgcatgggacagaaaccgaaccagtgctgtgaacgccgacctgtccgtccagctgacaagattccctacctcccagagctcatgctttccacgatggacaactgttttctgatgtgcacacctgcatccttttgcccaggcatgccccaagaacagtgagcattgattaagcactcaatgcttaatcaagtgcaggcaccttatgagttgatgtcatcatatccccattttacaggtgaggaaagcagagctctgggaagtgacagagcttaagtgaggccacagagaagtggtggggctgagtttcaagcccactgcatgtgactcttaaccactctactacatggtttcctcacagtaagacgcaatgaacacctgagccaggtgttgggagtttgtaaaacccctcaaagtcccatgtagggtcctggtcacagcccctaaggttcagcaacggctctgctgatctctctcacttatcgcccatctccacagccttgaaggtcatctttcaaccccataaacttccaagtctctttggtccagggcttcccactcctgatctccagcaggaagatttccgttaagtcttcacacagttcccaaagatctccaccagcctgggcacctacggaagttggggccccattactctttccccagggctctcttccctttgcagtcagagctctcagcatcacgtgcactcatgcttttgtgggctaatttgtctactttctctctcccttggcaggctgcattttccacagactgccacagcaatatctcccaccccacctgcccttctgcagggagaccttgactccctcatcataacgagggaccgaattctcctccacagtccccctcggggctggccagactcagtggctccttgaccaacaggatgcaacagaagtgctattctagacttctgaggctaggtcagaaggaggcttgcagcttccccctgcatctcctgggacactcccccttcaagcccagcagccataatatatgaagcccaagccacatggagagagagcacataggggctccagtcaacagctcccagcttccagcaccgacttcagccatgggagcacaccatcttggacatcccaccccaagaagcctttggatgacagcagctccaaacaccatgcggctgcaactgtacaagaaacacccagtgagactgccagctgaacccagttagctcatagtactgtgagaagtagtaataaattattgcttcaggccattacattttgggatggtttgttacgtagcaatggatagccgaccttctcgccccacaccggactataagctccatgagggcaggagctgtgtctaatttagctcagtgccacctcccccaaccctggcatacagagggacatatagtaggggctcaataaatgttgaatgaatggatgagtgaattaattgattggtttcaaaaaagcaggcctctgaatccccacacaggtagaggcagaaggaggggaaggggccacagtgcagtttattgtctgacgataagtattagattgaatcatataaaggtgccattttttaggtcaaaaaagttgaatattggcaatctcaaatggctcagcctcacatatgacgaggttgccctgtcctgccagcttcttcctgcagccaggaggaagagggtacacccacaccaggaaaccccactacaccacacccacccaaacccagcttccctgaacccaagatatggacttgggggacattctatgagcaaagagaggcaataacaaaacctttcacctcaatcatgtttcgctggaaagcactgaattttcaggccagtcacaatggcttacgcctgtaatcctagcactttaggaggatgagacaggagaacctatggagtttgagaccagcccaggcaacacagtgagaccccatctttacaaaaattttaaaaatcagccaggcatggtggtgcacgcctgtggtcctagctacttgagaggctgaagcaggaggatcgtttcagcccaggagttggaggctgcagtgagccgtgttcgcaccactgcactccagcctggataacagagcaagagtctcaaaaaataaagtaaaagtagtgaattttcccacctcactgagctactgcccttaagaaagggcttgcattcaagatgatgacgttgagagcagacagcggaccctgcagaaacgctgtgcagcaagacagatggccccatgccctctagagggaaggagcagcagaggccttgccagggacagagggccttgccagggacagagggaggtggcacagcctcccctacaccctgaggggagctgagtatggtgtgagcatctcctggtaccattttacactcacactgccccatttcgatgaggacagaaactctatgtggtaggtacaatggatatccccattctgcaggtaggtgcaatggactcacccactttgtcaatgaggaaaaaaaaaaaacaaggctcaggagcccattcaaagcacgtgccaggaagggcagagaggaatttgtatccaggtcttctgactctagatcctgactcttttttttttttccaagacagagtttcactctgtcacccaggctggagtgcaatggtgcaatctcagctcacggcaacctctgtcttccaggttcaagtgattctcctgcctcagcctcctgagtagctgggattacaggcaagcaccatcatgcctggctaattttcatatttttagcagagacagggttttgccatgttggccaggctggtctcaaacttctgatccacccgcctcggcctcccgaagtgctgggaatacaggtgtgagccaccgcacccagctgatcctgactcttaaccactatacggaaaggcagaaagggaatgcctgcaaaatcacggggcaggggacagctggctgggtccactgccaggaaaaggggaacggggagaggccccaggggaccagactgcccacaggctgccaggtctgagaacagcacatttcctaccttcccagcagggcttcgcaaggtcatgagccagggccaccagggcctcaccctcccaagggccagctagaaaagggtcagccaatgtcggcccctggccagcacacgaatcagaaggaaactcacccagaaggatgcctcttccttgctctcgtgtcccgggagtcagctagtcagcagagagccctgggcacactgaaaacctcccagccaccatcagaggtcccacctctggggccacatggctgagtatccacaagatggaggcagggggccaggagctgcctccatgcacccgagacagagagacctaggacagagcttgagagacatgcgacaaaccagggtcaacaatcacacgcactcacccattctttccttcattctttccacaaatacttattaagtgcctacggtgtgccaggcataacacatgcacatttgctgcaacatacggggtgctccccaaccccattcatcttggcggcctcaaagcccacacaaaggctggcacagaaaagatgcttaataaatatggggtgggcaaatgagtgattagatgaataaatgaatgcccaagaggatacgctaagtagtaaggggccggcatccagggctggggctggtcggggacccagattccggtcttagctccagtacacctcagcccccaaccatgagtgaccttgaccaaggcaagtcccctacctgagcctctgattcctcataggcccaaaagaagcctgaatctcatgaacgccatcctctccaacctcacagtggggaggcggggctcacctgaatgcatggccactatgagacaggcacacagctcagctccacatcaggggatataggagccttgtggggtttcgaggggataggggaggccagagcagggatggacgggaggagaaagggtgcaggggagaagggagaccagtggagcggagaaagtgagagagccaggaacactgccaggtgagagtgagagggcagcggggtcagcaggaccagcaaggccagcaagccctggaaaggcttccccacctctcacttcttctcccaatcagatttggatgggagaccataccacccacccctgcagaaagcagaaccaccaggcgccacattctaggcatatccaggggttaccagagaacccaactgtacaggagccatcgggacactggggtagaggagtgcagtggagctgatggaaccaagttgttgaaataaagacagtcattaagtaatgacacatacaagcagcagatggctggatgcatgttccagggactgtcggggatgacagagaaaaaacagaaaagaatcacaggctctgaagccagcctgtctgggttcaaatccacactccaccatttagcagctgggggaccatgaacaagtcacttgccctctctgggactcatttaattaagtcacataattttaataaggtgatatatacaaagccagatgcttggctcatagtacagcttgagacaatggtagctggtaagcactgtcttgctgctgggttatgattcaaaccaacatgtgcagcatcgcagtgcagacaaaagctggaggcgtcaaacccggaggggtctggcaggaggcctcacatgctcctgaggatgcaggaggacaaggaatgtcatggcacaggccctcttgcaaggcacgaaaatgtccatgcataccaaaagaaaaaaaatccactccatcaggagaggaaagtcctgggtccaagtgtgaatcctccccttcccagactgtgcgatcctgagtaaggtgcgagccacctcctccgtgaaggggtgtgatcagcttacaacccacaagcccactgttcttgtgcccgccctctgtaggtggctgagggaaaaacggtccaggaagatacctaccatttccaaagtctttaccctggagcaacacgtttgtttttttgtttttgtttggtttttttttttttttttttggagacaggatcttggtctgtcaccgagggtggagtgcagtgatgcgatctcagctcactgcagccttgaactcctgggctcaagcaatcctcccacatcagcttcccgagcagtcaggattacagatgcaccatcagacccaggtaattttttttcccccaagacagagtcttgctgtgtcacccaggctggagtgtagtggcacaatctcggctcactgcaacctctgcctcccgggttcaagtgattctcttgcctcagcctcccgagtagctgggattacaggcgcctgccaacgcactcggctagacccaggtaatttttaaaatttttgtagagatggggttttgttatgttgcctaggctggtctcaaactcccagcctcaagtaatcccacctcagcctcccaaagtgctgggattacagaagtgagccactgtaccccgccgacatttctttttcattaaaaaaaatatcctccaccctaacagcctgcacgtttcctaaaaacatgttcccgagggcaagatgccttttctgaatctgagcaccaggtcaaagccctggcttagcctctattcagtgttcgtttgggtcctgctcacagagaagaaccctctcctccatgaacactctctcaagcaggccccgggaggggtgtggccagggctgggcaaagagcccaccaaccccaattccgcactcggcttgtgcatccattgctggccccaaattccaaaaggcagccattatttatcttcaggtttaaaatatttgcagtgcaggcagcggggtaacatttaacactcagcctaaagggtccccttggcagcagagctctaggcaaatattttaacacataatttgctgtccaagttcggcttcttaaataaggaagcaacttcctgatggctgtctggggagaccccggtgtccctatcggtgcctgtggctctgtggatggaatttcaagccaaggtccgtcagagacattgaacctgacctcggctacatcacacaagccttgctgggctgctccgtctggccatgagggactgatacaggacaaccctctgcagaggcccacagaaatgactagaaacttccagagaacgtatcttcagttgtcagcaagtctagaacctaaaggactagcagtgtgatggcaatcgcctccttcaggccagaacttccaattcctttgtatctttcgcctcgtgacccccagcccctgtcagggagacgttaccaccagacctattttacagacggcaaaactgaggctccgatggctgagacagccccctcagtcactcggataacgagtggagagaagctctcaactccaattcccccaccaccacacaaattacagaaatgagtgtacaagcgaatggggtgtggagtgagcacacagaagcccacccagggaggggtctcaactcctctagatggtcagcactgcaaacacacctgctgcttttttttttttaaagaagaaaatccatggctcacagctgtaatcccagcactttggggggccaaggcgggtggatcatttgaggtcatgagttggagaccagcatggccaacatggtgaaaccctgtctctactaaaaatgccccaaaaaaataaaaaattagccgggcatggtggcgcatgcctataatcccagctactcggggggctgaggcaggagaatcacttgaacctgggaggcagagattgcagtaagccaagattgcaccactgcactccagcctgggcaacagagtaagactctgtctcaaaaaaaaaagaagaagaaggaggaggaaatccaccgttctctataaaatttctggatgatttctaaatgttgacttcaagttttaagaaacacagtatgggctaaacaatatgccttggagggctggtccagcctgggggctacccactgagggtctctgccatggagtgtgtccagcaagagcccctcagagcccctagagcacagggtcatctgctcattcctcaccagaaagagcagtcagctgagcagtcagctaagcagtgatgaaagtgtctcttctttagagattcaggaactgagttcaagtccatttttgtgcaagaccttggttgcttgtacttctgagcctcagtttcctcacctagaaaatgaggatggtactcatgctgtggatgctccctatgggaccactttccaggtgacctcactccaggtctctgcccaccaggcgctggtcagcagtgagctccctaaacgttggaaccatgtcagacacaaatcctccacatcttcaatcagtcaacaaacatttactgagcacctactatgtgccagcccctgttctagatgcaaacacatgaaagaaccatacacagctccatgaccaggacaggctgacatttggtcacaaggaccttgttttttatgggtgttccatacatgcacgaatgaatgactctaccctccctgcagggctcagctgccacaaaatccccggaaggtaaagagagatggcagcttccccaacctcacagacacttgcactcagctctcaactacagtgggtcaggaatgagtggaaagaaaagaaggcagatgagagggagggaagaggggaggagggaagcaggggggagaaaaataaacctcaaacaccccctgcaagaaaaaatcaaatttatttttccagcaagtagttaatggtgtcactcctccaagccttacaatcttaataaaactgatctcgccgcgtgcagtaatgaagaacagtcagacaaagccaccctggaaccatgaaaattgtgcactgttacctcctcgtgacctcctgaggcagtgaccattctgccctcgccttgctgtcatgttttgtctctgggaagggggagatgggggagcagggccggcggtgggcaggggagggaggatggtcaggcagcgtggggagctcgataaatccagctaatttgtggccagtgctagtgcctgacactcctaattgctctcagtcctggagcagaactcaaggctaggatgctggggcgcaaatcaccccccttgtggctgcaaaaaaaggatcccggttaggggaagaaaagcagggagaggagggatctgtacccctaaaaccagaaccagtggccaggctaatggagtttggctcagagccaaggataaacagaggcggtgtgaatggagagcccagagcccaggggccaggcatcatcgctgtgcattccgggcaaggtgtgccctctctgggcctcagctgccccatctgtaaattaaggcatggaccacagagaagcaattttaaaaaccatgcaccttagcagctcaacactgtgccaggggcaggcctgaggacagaactctaagacaacacctccacacccagggagccccgctgccgcccgccttccacgccagggtcccgcagcagcactttgcagaaagagcctcactgtcaaaatagaaagtgtgtaaaagttcacctgcccaactcctcctcaccgttcaggtctcagctcagtgaatctgcacccccacagggtcaggcctcccctgtgagctctgggagctcgctgggcacctctccttctccacttatcatagcagtcctcatgattttatttgctggatgtgcgaaggtctcctgggcatgcaagctccaggcaggcaagtccgcatcagttttgttcactctgcttcccccttctccacctctcagcacccagcatagggcctggtacacagcaggtgattaataaggatgtgttgaagaagctgtctggaagggcccttcccactctgacatttaaagatccagccacaggtctgtatttccagggagggatgggacaacaggaatgaagcccgaagcaggcccctggtcctgcctgctgccccgggacacagggggctcaagggactccccagacccggctctagggcctctattataacccaaaagccagcagctcccttcccaccaatgatcctcctaccaacgagcctccaggtgggcctggagggccaggggagccccctctccctccagtcgcagtgcagaggctccacaaaaagcctttaaaaattaaccagttgccaggcatggagacagcctggtgcgcagccacgttccagggaatacggaagtggcgcctggagaaaagggagcaggactcgtggagtggctttcccgtgctatcccaccccaggaggagtacactcagattccaaggagccgctcccagtaaacccccatctaggcacccactcactggaggagggtggcagcctcagcccacctccaaggatccatgcaagcagctggctcctccaggagaccccaggggtctccccaccgcttaccctcatccacttgctcaggtctgccggctttctgccgacttcccgtcagtccccaagagggtgtttggagccccacaagtgggctgtaagacattctctgatgtctccagaaacctggattctggaagcaaggcacagaacaaagccaatggcctgggcagcatgacacgtctgccacagaggtccgagaagcctcagcacacacacagccaggcagggtgtccccatgctcagcacacatgtggccaggcaggctgtccccaggccgagcacacacatggccaggcggggtgtccccaggctgagcacacacgtggccaggtggagtgtccccaggccgagcacacacatggccaggtggggtgtccccaggcccagcacacacgaggccaggcggggtgtccccacgctcagcacacatgtggccagccagggtgtccccagctcggggttggggtgtacccagctcggggtcagggttttgatggggactgcactcagaccccccagccagtgacagcaaggcctgtttggcagcctaggacccctggattcacattcctaggcaaagagatgcagagacatggggggattagccacaggccaaaggtcaagtgaaccgcaccaaggaaacttccagacccaccccagggacctggctgcctctgcctgatggccaatatcagtgtgatctacatgcacacgcacaccccacaccccactcaccacccccaggctcctcctcaaaccatcacttaactcggatttcaaactgctggcgatgttctttagtcaacatgaagcagaaaccttttattaaatgctgctaattttttattgatcacactgtgaatcatttcattttccattaccgcaaatgtctcctatcagagctccacgatcaggcttctttcttcattcttgagtaacttgtcacttttaatcagttttcagtttcggtctggctcaaaaattagaaagcgggctctttgtatcattattgcttttgtttaaaaaaaaaagtttccatgcaggaaaggttattatactcagaataaatatacatgaatcaaattcagatgaaattcctccctggctctaaccaattttaccattagcttttataatttttttaggtttattttcacagaaagactgctcataattattgctcgtgctctcccaaaacacttatgttactaaagtgcgaaatgtcttctaacacaaagacagatctctgggaagtaattacagaaatgcattcaggggcaataattctatattagctgtcagcagcagacatcctctgaaaggcacttgttatgaaggaattatttgtgctactattgaaggcatggcaggcaagcccaaacttaaagactgcatctgatcagaaacatgggctccctcatcaagggtcaaattaagtttaaatcattaccttgaagcccagcaaactcgtacctgactgtctattgtgaagacatttttgaggcgcactcgagcgcgacgtggtcttcccgttcgcagcgtggtgcaattacccttagtctcaaaaggattctgccaggagcttgtcacaatagggagagaggaggtggcagggtgtctattaaatgctaactcgtgtcaccaaacagaattttcaagaattataaattgccgagatgccttgccgctgaccccctcgtgttaagaagagcccagaatattatcaggaaagtgcaagaatttgcatcaaaggcaggaaaggactctctatggggagcccacggggatggagctgaggggactgggacccagtgaactatcccctcaccccacagaaggtccaactgggatctgcgccccaacaccagcttactcagggcagagaaataccctaaaatgaggacaggtgcagggggatctgaggaagtacgtaatttcatctgagctttgtccctaactcttggcatgacctcaggccagtcacttcctctccccgagcctcagtttccccacctgtaacaacatcctacatcaactctgtgtggagggcattctgtgagtggaatgcaatgttggcccctgctgttccaggctctgtttccccacctataaaagtgcaggattaatttcctgcaccgttaaaggaatcacctggccactgggtgcgggaagaaaatgtgggacaaagagcagagcagcttcctgtgagagcgggtctcacagatatctcagatctgcttggactcatcgagcctcagcttccccacctcaaaagaggacaagctaaaggtcatagcctggggttgcccttatcaatcacagtgaagcacaaacccaggcttctttcatctgctcacctactgctattgccaaaaagacagggtactttctctttttttgagacagaatcttgctctgtcaccctggctggagagcagtggcacaatctcggctcactgcaacctccgcctcctgagttcaagagattctcccgcctcagcatcctgagttgctgggactacaggcacccaccaccacacctggctaatttttgcatttttagtagaaatggggttagctggccaggcaggtctggaactcctgacctcaggtgaaccacccacttcgacctcccaaagtgctgcggttacaggcgtgaaccaccacgcccagccaagactgggcgctttctaagacagctcagggcaagaagcaaaagaactacttcctcctaacagctggagcccatctacccgaagcagcacctcacggtgcccagcagtgctcagcagttgtggcacccctagccgtagcatcctgacctttccctgacctccgagctcggcccatgacccaagtggggacactaagacacaatccggagatatgctagaaccaccgggaaagaaggtacttaaagtggggagagcagagcgggcagacagagatcgggggaaagagtttgagccatgcccttcgactcagtcactgcccacagaagcttatatcctagaaaactcctgtttgtgaaagtccgccgtgagagtatctgctgcaggatgatttgtaatagccaaaaaaaattagcatctacatctccatgaacagcagatcgatagatagattgtggtacatttacagagtggacaccatgcagcaattaaaattaatgaaacagctacatgtatcaacacggattaatcttccaaacataatgttgagagagggaaaaaaaaagcaagttgctaaagataaactatctatatggtaaaatatggtatctatattgttttaaaacatgtatatcagtagtatttaaataccatttatatgtatttccagaaacaagacatacagggaaatgaagaattgatatcatctataattaaatatcacatatctccagaagcaaggcatacagggaagtgatgaatgccaagccctaacggggcaggaagagtagggcactctggcactcagctgggtgaacgattccttaagctgaaaggtatatcctggacagtcgttattctcttctgtttatctgagatatttcatttaaaaaaaaaaaaaacaccattgctgagccactgaaaatttttagatcataaaagtttttaaaagaacagtgaataaattggagaaccacagggaagcacagaattttagatggagaaggcactgaagaagacagccaatccaatccagcgctttctcagaatctgtgacgcaagagattgtccccagggcacaaggcaagttagtggcagaaccagggctattgccccagccctgtgctccttccctccctccggtgtggaggagcctagccctggttaggggatgagcttgaataaatggtactgaggtgcacagtggctgtcacttgtagtcccagctacttgggaggctgaggcaggaggatcactttagcccaggaatccaaggccagcctgggcaataagtgagaccttgtctctataaataaataaacaaataagacctaagtatattgttctctcagagcaggaacttctatctgttcactgtggaatccgaagcacctagaacagtgcctggcacgtagtaggtgcacaataaccccgtgttgaatggatgaatgaaggtagactgaggtgattaaagtcatgcacatcattccataaagcagaccttcttggacaagccccattgctggacaacaccaagttagtcatttttcagtaaatgcagattttccacctctgagtttaaaaagaaaatcacttctcaccaattttctgaccctcctgtgggtatgctgagattgtgagtcatggctgaggctggaaaaccaccttcggggagatgagaatggaaaacggcctaattcaaggaggagccaggtactgcctaaaacgcgtcttggcccccttccaggagtgcacatcgaacggaaaaaattactccaactctctccgtaggagaacatctgccagctggccgaccaaagtagctggttgctaagaaatcacaccgggtgacatcacctgatcacttactacaggcaagacatggccagggtcagagttcaaaacagtttctggaaatctttccagcgaagccccttttccgtgcagggatgggaggatgggaaagtatcttgatgggtacccacctgtgaccccctgccctatgacagaggtactattacagatagggaaactgaggccccgagggggaaggtcactgctagagggtggtagaagaggggttccagcttcttctgagcatcgaggtgcttcccgggataccaggttctgagccccgctgtgtgcacccctctcatgcagaaagaggtcaacagagaagtccagcgcatggtaaagaccagcgtgaccacaggctgcagcttttccacatggacaatgcggtttctatggagtccaggggctacggtcccatctccacggcattaaataaagagacgaggaaggtggcgaaacagcataggagagtaacctcctctcaagccaaggcaccactccacaggggtatctagcagcaccaagtctcaccaaagacagaagccccagaagtgaggtcccctgggagccctgggctatgccaggagcaggagtgggtgcaggaaggacccagcccacccccacaagaaacgcccatgccggggaatctgcccacactgcaacaagcatcccaggtcctgaccttgacagggatgcagggcgtgcattcggccagcctgtggtcttacccggctttctccccagaactgcttctgtgtttctgagtatctttccttcccagaaaaaaacgatgctttactgttatttctgattacaaagataactgcgactgatgtcaaagatacaagccatacagaaaagtataaagaaaaatagtaaaaaacacctgaaatctcactaccagagcttggggctgtgaccactttgatgagcgcgatcccgcacatcctctcctgcgtttacggacacgcgcagcaatcgccgtgtgcgaatgggatcctgcgccacacgctgatttgtaacctttctacactttgttccactcgcccctgggccatggtcatctcttccagggatcgttttgagagtctgcctttaaagtttcgtctggagggaaatcacacgggtccacaactcctagttaaatgtgaacaggccccagtagtgaattggggaggggtgggggtggggtttctatcttagaaaaggtttcctcgctttgcaaatgggttcaccctgggagtctttgcattaaggagattctccctcccgcgaacgcatgtgtctctggaggtgcaattcagggggccacctgcttcagcattgctgccatccactctccccacatcccagtccatccgtgcagatggaaagggccatgtggtggagagttggggctgaccttgaagggaaggctgccgtcagcccataccttgccgaacagcccatctctggctgtcactcacacctgtgcaggcaagtgcaagctcacctatcatgctgctgctcggggtgagtcacatcggggctgcttccttgcacccagtgatctggggaaaagtttaggaaattcctactctgggaattctcagttggcggcttcctctcctctttctcctccaccaataccccttcctaggcacaaaattgtgaggcttcctgggttttgtcactaacatttaaatatggggcttcaagtcatcaccctccaggggccaagtcaggggtttccaagaagtccctgcattcctctgtcctgggggatcccaggtgggggaagtgggctgggtgtttctgggaagcagactcctctgggaggtaccttcctctctttctgccaactgccagcactgagtcacagaagacgtgtcagccagacacagggaggagggccagagcccccagggtcagccagacgctcctctccagaagagaggcgcaggggcatttaaggccatctgtgcactcacaaaacactcacggagaccctgcaacgtgccagggactgtcccagagcaaaaccgggaatgaggtggacagatcctctcagggagtttaccctctagtggggaaaaagacagaagatgcataaatagagaaataaaatcattgctgtgagtgatcagcgcatccaaggaaataaaataattgacgtgacaggggctggaagacgccagctccagccagagtggtgagggagggagagcctcactgaggaagcagcgtgagccaagctgcagggaaccagacggtgatggtgacagtgatggggagcagcaagcacaaaggaacctgaggcatggagcatcgtgcactccaagaaccaagcggaggccagtgtgtctacagcacagagctgagagacagaggcccgacggcgacgaaaggcccgaggaaggcccaggacacgccatcaaatcctgaaatcagaaggtgctgggagagcccctcaagcggcccagagtccagtgcacacaactccattcaaggcacacatgggaactccagactgaagatagactgcaggtgctcatgtcacatacaagactgtttgacagcctccgtactttaaaataactcagcttggtcaaatcttttatttttgttgttgttgtatgagacagggtctcattctgctacccaggctggagtgcagtggtgctatcacagctcactgcagcctccaactcctgggctcaagtgatcctcccacctcagcctcccaagcaccaccacacctggctagtttttttcaaaaatctgttgtagagatgaagtcttactatgttgcccaagctggtctccaactcctggccacaagcaatcctcccaccttgtaatcctagcactttgggaggcagagatgggagcccacatgagccaccgtgcccagcctaaattggtcaaatcttattgggaaacatttctaacatgagagttctgagttagcaatatgtacccagctccatgcaaagtgccttggcctgggcactggctgcaaggtcagacctgggttcaaatcccatcatgacctcagccagaactagtcttctgatttattaaagagtaaatgatcttcaaacccatgctgggcttctgagtgtcgggagaggaagaagcagtaccacccatgcatgggctctgctccccaaaataatgatgggatcagccttgccaactcagcaactatgacagagagtggagcttggtgttgtctgccccagaggtgcactggagccacagtctgtttttcttccttccaaggctaaggttcagtggttcagaactcaaactcccacccaggcaggacagtgaagaggcccccacagcccagggagggcaaggtcttggccaaaaccccacagcaaggagggagcaaatgcagagcagcagctcatctcaggacccctagtgcccaccccaggctctcctggcccgtatcaaagtgctcacccccaaatccagctcctgcagaagaaagcagaattgtgtggccacatttccccctgcctgatattcactacctcaggaatcaaagaatgcgggccactgtgcccgtgacgtggcccaggaaggcattgcaaacaggtggcctgatgcctcgcctggcttccatggcccccaggcaagaactgcacaccggaattgggagagggggtgcacaccagtggccctcccccaccccacatggcttgggcctggggtcttcaacatcccttcctgacggtgtcccagccacagaaacccttgcataaccacctgggcatccacagcaccagccatttgacccagtaggggtctgggggagcaaggctggtccccctttctgaccatagcaacatcaccagagaactctagccctggatatctctccaagcctcctgtccttttcaaaggggagcccagggaggccagggagactgtctagggaccacaggagggtggcccatagagcaagcaggcttgctccaggaggtcacagagcacagaacagaccccacgggctgatcaggaggagaaaaaacctgcacaaattcatcgggacaactgagggcatgggcttgaccttctactgactggagatgcatccccgtgtgaccctaggttaattacttaacctctctgaacctccatttcttcatctgtaaaatgggaggttgctgtggagctcattcaaggtaacagagagggtagcatgagcctcacatgtcctcacccactcaacaagtcaggactgcggggctgctgtgtgccaggcaatgtcctgggctgggaacacagcagtcaaccgcagagacaaaatccactaggcagcaaggaatataatcatcagaaaatcgaccaggcacagtggctcacgcctgtaatcccagcactttgggaggctgaggcaggtggatcacttgagggcaagagttcaacaccagtctggccagcatggtgaagccccatctctactaaaaatacaaaaattagccaggcgtggtggcgtgagcctgtagtcccagctacttgggagactgaggcaggagaatcacttgaacccgggaggcagaggttgcagtgagccaagatcatgccactgcactccatcctgggcaacagagcaagactctgtctcaaagcaaaataataataatcagaaaatctcagggggtgataaatgcaaggcaagtattgaaacaaaggtgataggaggctaggcgcggtggctcacacctataatactagcactttgcgaagctgaggtgggaggattgcttgagcccaggagtttaagaccagcctgggcaacatagcaagaccctgtctacagaaaaaaaaaaaaaaattagccaggcgtggtgatgtgcacctgtagtcccagctacttggaaggctaaagcaggaggactacttgatcccaggagttagaggctgcagcgagctgtgactgcaccactgcactccagcctgggcaacagagtaagaccctatttaaaaaaaaaaaaaaaacaataaaaggtgttaggacaggaactgttgaaaagcaaagaggcagcttcagctctggctatcaaaaaaggcctctctggagaaaggacatttgagcaaacacttgaatggcacgaggaagccaggcatttggctgggcatggtggttcatgcctgtaatcccagcactttgggaggccaaggcgggcggatcacctgaggtcaggagttcgagaccagcctggccaacatggcaaaaccccgtctctactaaaagtacaaaaattagctgggaatggtggcgggcgcctgtaatcccagctactccagaggctgaggcaggagaatcacttgaacacgggaggagaagggtgcagagagctgagattgcgccactacactccagcctgggcgacaagagcaagactccgtcaaaaaaaaaaaaaaaagccaggcattaaaaggtggaggaagaatagtttgtttatgcaaaggccccaacccaaggccaggtcaggtggggtttcataaagaaacggggagaagtttggctttagtaactcctccttgttgagcaaggcagtggcattgcccccacctaacctgccctctctctacacacttttagttttcaaagcattcatcattgcatttatcagttccctcctgcattcaatctggcgtaagctccaagagggcaggaaacctccatccagggtcattgattaatccccgatgcctagcacagtgcctggtccagaagagattctcaataatgtttgtttaattaagtaattataggcactcagtaagtgctcagtaaatgtgatcatcagggctgccaatagggatcaagctgctttggaatgagatgagactcccatccctggaggcatccaagcaggacctagaagaagacatgctagggaccctcagacccagaagaggcttccaggtcctcttccactatgaaagctgtcaggtctgccctatgcccagtgcaagggatggaggggcagctcgggctgcctcagggacagacagcgtctcagcagccgtaacacatgtgcaccaagccggagaagccgcctgcatttctcaatcactagagatgtatttgcacctcaaagtgcggcctcctgcactgcttaatgaggaaagcaatcattatggggggcttgcgggcctggggtcggaaggaaagaaaaaactttttttgccaacattgtgtacagagtgccaggcagaatggacttaaatcctccctcaaagggccccctgggcagggcacttcctgcagacaattggaacttggcctgtagggttcaacttcctttgtgttaactaatttctgactcagggttttcagctatttctttctagaacaatacactcactgcaacagtccgccggtgcggctatcttccgcggtggcagcggcacgctctcccctgcctccctcctcagcaggaggggagggaggtgtgaaaagccatcgaaaagaggtggctgggagcggtcaagccctgtccccccacaagtgcaagtctcattttcagctctctggagccagaatgcaagacaggaccccaggaggggtctcggagcccccaggatttctgggcaagcaaataacaaagcaggcgggaaaagagggcacagcccccagaagaaaaccttcctccctcggtcattaaccgagcccaccagaaccctcccgcctcctcgcccgctttcccgtttctgtaatctttttctaatctgcttgccgcttcctgcttcctccaaaccaccttaattgggaactctttagttcacaaggaaagttcatttctgctctctgaggacacctatcgagggtaagccaggctcttcatcataattcttaccagacatggctaataatgaccctctttcgctaatgaaaaaaacacacacatgcacacattgtggctgcggtaattaagcctgtgacgagttgagttggagagaaattagatttatttacacgctgttctgttgctgatgaagcacaagctatcgggaagctttctcattaaccctcgtttacagggtgtgtgctcttttgtgcctctacgaaccctctgtaaattgtagttggttaaaaaataataataattagccattcttagagtggagttttctcctataactctgttaatcctcgagttacactgcccagatgctgatggtaataaaatgcccaaaggacttcaggtctgagctgcagccacatcaatgcatcagccaacaagtgttgccggaatgcctgccacccgaagaccctgtgctagggacccggtggagtcagagacggccctgcctcggaggagatcatgaaatcttcctactggaaaggaactgggtgagtggctgattgaggcagaaagaatgatgcaggggccagactgaaagccaggctgagtccaaggttcaggtagaagaaatagggagccactggaggtttgtgagtgagggaggggaggcaaatgcagtgtttaagcaaaattagatgacagcccacagagatgactggaaggtttcagagacaagggttttcaaaacggacttgctgttttgaatcctgggggcagcctgcatcagcccaggccgcctatcaccagttacgacagcctgtgaggtctaagaggctctaagtgtgtggcccaccactatcttaatgacagctctctctttggagggactgtcattttattaaacacacatacagacattaaaatgcttcccaatttcagaaatgttaggcaatgacaaaatacacatcttagaatgaaaacagcatgaacatcaagcgcttggaaaacagccttttggaaggccagtccccgccacactgatacggaattggacccctccccggagttccaacactggcctagacaaagagcacccggactgccacagatgactccatggcacctttcaggggcatcttcccaccaaatgcgtgtctcgaaaggtccctgcccatcccttaagcttggacccagggaagcttcaagttggaagggacctaagagaccacctcatccagcccagctctcacctgcatggaaaggaggaggtggcaaccatcaccacctcccagggcacacgggcaaaaaggcacgggtcatgggtgggctgagaacagggggaagcacccatgatgagttcggacacttgtgagcacccctgaggacaagtccattgcgagatggcggggggaagccagcatgcgcggggaggggcagacatgaacaggcctcagaacccatgtccacatggctgcataattccttgttttcttctagagtgtgtggcacttttaaaagccaaagtcctgccaaaagacagaaaccccacctaactatagtgagaagtcccattttgtgtcaccaacacacaatagacaactggccctgtgcaagtgtttttgtttttcttataaattacttgtcacgatgcacaatgacagttatttcttttccattacgctgtgcaatgttgggactgaatccaacactcctgtgtcctccacaacaaagacaaaaaaatagacttttaatcaacgcttatttataaatgaggccaagaatttccattctcattttttcctgtttccatgtgctattggagattccataggttcgtgatgctcttcctgactcagcttaaaactggctacaccgacatctcctacagtctgaacttctaacaaagggagccttcagtaatgagtcataaaaccactatcctgttcccatgtagagaagattaggtgaataaggaggccagccccctgctcctaccaacagcaaggcttgatcagccacctgcttgaagttaagtttccaggacatgaggagcacctgcatggtgaggactgcagaatgctgttgacccagcatttgaaaatcaccatagccctctcccatagaactcacctgtcagtaacttctaaaattcaacacatccctcaggctattgtggacacccaaaccaagccagacacgtgaccacctgcctccaaatcccccttgggtggggtgaggagcccggctcagcaggaaatacacccctgtcatcaattctggtgaagaaaggcctcaaagacaaacaccccacgtgccctggacagccccaacagcaaactcaggtttccctgccgtggcaggtgggagattaatttcccccagtgtactgaaggggaaagaaagggaaagaaagaatgacgcacaggatctcctttcccctcatgttaatcctcccctgacccgccctcggctcctcccctccacactgttggtccccctgcctgtggtcaccctggttcaggactgcggtacctcctccccaggtgactgtaaaacatccctggcatctccagcctctcatcaaactctgagtgaacacctgctaaatggtaggcacttcctgcctcgccttcacctgccaaaggtagaaaatggtttacccgggagcctaatcaccagaagcttccagatcaggaattgttagaaaggaatttgtttttttgagacagggtctcgctctgtcaccgaggctggagtgcagtggcatgatcttagctcactacaacctccgcctcctgggttcatgcgattctcctgcctcggcctcccgagtagctgggattataggcacccgccaccatgcctggctaatctttgtatttttaatagagacagggtttcgtcatgttggccaggctggtctggaactcctggactcaagtgatccacccccctcagcctcccaaagtattgggattacaggggtgagccactgcgcctgaccaaaagaatttttaaaataatcagctgggcatggtgactcacacctgtaattccagctacttggagggctaagtagggagaatcgcttgaagccaggacttcaagaccaacctgaaccacatagtaagaccccatctctacaaaaattttaaaaaatatccaggcatggtggcatgcacctgcagtcccagctactagggaggctgagatgagaggatcgcttgagtctaggagtttgaagctgcagtgagctatgatggcaccactgcactcccagcctgggcgacagagtggtctccaaaaaaagtaaaataatcatcactacaaaaaaaaattactccctcatgttccttaaagaatggcactccaagtctaaattatagtggcaaggggtacacacgtgagtgacagaactttaaaacaaagcaagggtgtgatcaccataaaagtcaagctagtgattctttctggaaggagaaacagggatggggaacaaggataagccttccgaagtagcttgcaaagttctatttctagacctgggaagtggtttcaatggcgttcaccttataaaaattcactaagttctacattgactttgtgggtttctagatctgtgtttcattttgcaataaaaccatatttttaaaaaaataataaaaggaaagcttgctggctgggcatggtggctgtggctcacgcctgtaatcccagcaccttgggaggccaagacgggcagatcacgaggccaggagttcgagaccatcttggccaacacggtgaaaccccatctctactaaaaatacaaaaaatcagctgggtgtgttggtgcacacctgtaattccagctactcgggaggctggggcaggagaatcgcttgaacccgggaggcggaggttgcggtgagccaagatcgagccactgcactccagcctgggtgacagggcgagacgccacctcagaaaaaaaaaaaaggaaagcttgctatccccttgcctaggtgcaatgcaacccaagagccagcgaatggctgcagggtgacatctagccagcccagggtcaacttacagataggtgctacagaccctaacagacaaccctggcgggaccacagcagcctcaggagcagcacatactcatgaaagttctcagccaggagtgcgctttgcagggcaatggctgttgaaaagcatggagttgcacttctgcaaatccagacaccctctgaaacttcctgcttttaacccctgtgacagcttagagttaagatcccaaaactctggaagtgttgtaagtttggaatgtgttgggtgcctaacattccaagtgtaaagtccttttttgtgtaattccacaacctccttcagacgtcacaggaggtggccctgtctgtgcagatgagactagggtccctgctgcacctgccctttggccctggttctctttagagagattgcgagttgtgggtgttcccctgggctgtagctccaagggccaggatcactttagacttgcttacactgtaaccccagtgcctagtgtttgcttagtgaatgggtgaatggatgggtagatcaatgggtggatgggtgggtggggtgggtagatggatggattaatgactgaatggacagatgagtggatgaatgggtggatggattgatgaatggatggatgcgtgggtggatgaatgggtggatgggtgggtggggtgggtagatggattaatgaatggatggatggatggatgaggggatgaatgggtagatgagctgatgaatggctgaatgggtgggtggggtgggtagatggatggattaatgaatggatggatgaatgggtggatgggttgatgaatggatggatgggtggatgggtgggtgggtggggtgggtagatgtatggattaatgaatggatggatggatgaactaatgaataaatttgtcaccctttcacaagagctttcctctccagcatatcctctaggggattaggaatcatatttgccttacttgccacggacccatcagcacctgagtcagggttcggcacacagtaggcctccaatatatttttataaatgaatgggtgaagaaaaaccaactgtgctagggatagaggatacgaagatgaccaagacatggtcctgccgccaaggacctcaccatttagccaggaatggagaaacacacatcagacaatgtgatgagggcaagcagcacaagataggagcacagacagaactcgaactgagcagagaatgagggagggcttcccagaggaggggacctggacctgactcttgattgaaaagccagaaagtctccccctgagactcaggacagcacccctaggcggtggttggggtcccctccaccccactgacttctcccccgaccatctgctatatccattgcttccaagagtcatctccccaaattccccctgccatgccgtcaccaccacctccctccaacacacacacacacacacacacgtacacacacgcatacatgcatgcacatgaacacacatatgcatatacgcacacacgcacacatatatacacataaacacatgcacacgtacacacacatgcacacacatacatgcacacacacacacatgcacacacacaccctctgagaaggccctttgcctcccaaacacagtgtgacctgagagaggttcagcccaggttacttgccctctctgtgacctgggtctccccagcaataaagggagacaatgacaatgtctacctcataggactgctggtggttaaatgtgagaaaccatgaaagggtcctgcacaacactgggcaccatagctgccaatagctccattctgactgccattgctacgactgaggaggccatactacagaggaaagcaaacctggcctgtgccagcctgctcccatgccacggcagggccttcaccctacacacagatccccagcgagcctgctcaaatgcagattctgcttcagcaggtctgggaagaagcccaagattgtgcgttactagaagctcccagtaaggagaacgacgctggtcccaggaccacgctctgagtagcaaagactcagcccaactgaactcattacctcacctgcaaaacaggagccataaaaaccacctcccagggctgttgtaaagagtaaatgcagcaacatgcgtgcgtatgggagccctcctgcacccagataggcacagagtgggtgctgagaaaatggcaactccttcctccatttcctccctcctcttctcccactaaccagctaattctgaatactattgacctctgcacaaacatccaaggtacagtaacagtgttcaaataaggcttaataagggaatgaatacatgaacgaatcctttaaaaagagagagagacagggtctcattctattgctcaggctggaatgcagtggcacgatcacagctcactgcagcctccaactcctggactcaagtgatcctcccacctcagcctcccaactagctaggactacaggagcatggccagttaattttttaaaaataattgtagataagatgtctcactatgttgcccaggatggtctcaaactcctggcctcaagtgatcctcccacctcagcatcccaaagtgctgggattacaggcatgagccattacacccagcccaaatccatatttaaaagctgctcagcaaaggcgttgaggcccagcaggctgagcctccgtgcccagacacctagagaagcattatgttcagaactgccagccctttcggaaaatgcctgtgaatctcaatccccacaccaggttgtattagtcatggtgcacgtcccccagcgccccagaaggaagtgggcctccactgagggcctaagctcaggcagtgtccacctttccccatgtcttccctccatctctggctataggagcccatgatgcccagacagaatgccccacacagaagcctgtggccagcccttcgcagggcacaaagaccccgagtgagcttcccaacctctctgtgaggctggtgagccaggaatgaccatgtctgtgtctagacaagaggactaatgttcatgaggtcaagcaatttgatgaggtcaggccaggaagaagaaaagataggcatcctgcacctcattctagaacaatttccccagcataagaaggcccaagacttactttacaagtgcagaggggaggactggagggctggcagctgtcactcaggaggtgcaaggacactccagactctcccactaccttccgctctcgggaacggcctaggtgggccctttgactcttaccttcaacaccccatctgaaggctgactgagcccaggcaaccagcccaacgcttggtcttggaatatcttattctaataattgagggggaaataagccaagtaaaaagcccacaacctccacatcactgaaatgaaaatgtttaatctcatcagttcttttcacgtccctttcatgatcatagctcactgcagcctcggactcctggactcaagcaatcctctcacctcagcctcctgagtagctgggattacaggcacacaccaccatgcctggctaatttctgtatttttagtagagatggggtcttgctacgtcacccaggctagtctcaaactcctggcctcaagagagcctccttcctcagcctcccaaagcactgggattacaggcgtgagtcactgtgcccagcatccctttcttattcaggtttaactcacaaatcttaagcaaactgggtgacagcaggtatttttgttgttgttgttctttgtactctgggttttttggtttttgtttttgttttgttttgttttgtttttgagacagggtctcactctgttgcccaggctggagtgcagtggaacaatcatggctcactgcagcctctacctcccaggctcacataatccacccacctcagcctcccgactgggactacaggtacatgccaccacacctggctaatttttgtattttttctagacatggggttttgccttgctggacagcaaggttttacataaatgagcacacaaatcaaggtatgggacattccctgcaccccagtaggttcccacatgtccctccaaaggcagtcacttcttcgcctctatcacagacatccactttgcccactccccagcgtcacaggaacagacacgtgcaccccacttctccgctgcctctgcttcctttgctcaacatgatgtctacacgagtcacccacacttgggggtggcaactggttgttcatctttattgctgcgttcatgccttcctgttaatttttgttttccaaagggtcagtttccacccaatccttttgccccatccatgtcaccatgaacaaacagaagaccacagatcagatcagcccgttccttccttcccaccatttgctgggtagctcgtttaaggtttaaagcatttccatcaccatgtctggcaaccagacaccactcagcggagagctacctctcctctgacggacctttgtgcagaaagtctcacggctgaggcagcctgctggccccacgggcaggaggagacaggaaaggggctgtgtctgtgagtcacccactcccacagccaaactgcaagagggaggaggtcgatgtacttttctcaggccaaagagaggatgtgtgtggggaagatggatgttggcaagagcccccaaccccacagaggacccctcgctcccatgccctgctgcggggaacatgagagccactcccagatacgcagcctctcaccaccagtcccctccagcataagagaagaccatgctgcactgggtcccactcaccccaccattcctgaacaaattaaagcaacccagtgtccatcaacagaggaagggataaacaaaaagtgggctagacacacaatggactatgattcagccttaaaaaagaaggcgggctgggactgagctcatgagggcctgcagagtggagacttaaatccaaggtcagggcaaaacatctggagttcattgccaggactgtgatgttacagaaaaggaccgtgaaaggtgcgtgcgggacccaacacagaatcgtggccatgaatgggctcgctgaggacattcgacatcagcggtgccatgagaagccatgccaccagcaacaggggaaagctacggaacctgctggcagatctacagcatggagatggctccaaggatcaacctcttggtggaaaagaactgtctggatcggcggggctgctgagcctgtggatacgacacccacctcttttttcttttctttttttttcttttttgagatagagtcttactctgtcccccaggctggagtgtagtggcacgatctcggcccactacaacctccgtctcccaggttcaagcaattctcctgcctcagcctcccccagtagctgggattacaggtgtgcgccaccacgcccagctaattttttttttttttttgtatttttagtagagacgcggtttcaccatgttggccaggctgggctcaaactcctgacctcaagtgatttgcccgcctcatctcccaaagtgctgggattacagccaccacccccagccaagtgcctccacctcttttcttcctgcaaccccattcttggttacctttctctaccttcacctcaatcccatgtatgcaaaaaggctgccacatagagaagtaaccccatgagccagcaatgagccttctcttttattaagtgaaagaaaaaactgagtagaacagtgtttgccagggcctgggaaagggcaatggggagtttgtgttttaatgggaacatcgtttcattttgggaagatgaaaactttccgaaggtggatggtggtggtagctgcactgaaaggtgaatgtactgtaacgccactgaactgcacacataaatggttaaaatgataaatttcatgtgacatatattttactataataaaaacaaattttcctgggtacagtggctcaggactgtaatcccagcactttgggaggccaaggcaggaggatttcttgatcccaggagtttgagacgagcctgggcaacatagtgagacctcatctccacacacacacacacacaaatattaattagctggacattgtagcatgcacctggagtcccagttacttgggaagctgaggcaggagaatcacttgaggccaggaagtcgaggctgcagtttgccatgatcgcgccactgcactccagcctggacaacagaacgagaccctaccttgaaaaataaaaaaataagtcaaagaaaagggaggaaattctaatatatgctacaagctggataaaccttgaggacattatgctaagggaaacaagccaggcacaaaaagaaaaatactgtatgtctccactcacatgagggcctggctgcagtagtcaaattcatacagatagacagtagaatagtggctgtcagggcctaggcgacggggaatggggagtgagtgtttaatgagaatagagtttcacctgggaaaatgaaaagaactctagagatggatggtggaggcagctgcacgagaatgtgaatgtacctaatgctgctgaactgtgcacttaaaatggttatgatagtaaattttatcttatgtattttaccacaatttctaaaaagaaaattttaatggaggaaaacagtagaatactgagaaaatgtatagcaggcagatgcaagaaaattcaaagcagaagtcaggatattaacataggaccaaatgcaattcaagggaaatatcattaaataagacaaggttgtttcatgtttttttaagtgaaggtttgcagctccagcgagcctaaaggaggagccaggcacagcggatgaggaaatctcctgcccaagaagtgacaggaaggctcctctccctgctcacacaggctcccaacatcactcccaggaaaacaaggtttgtggcaggcaagaaaacgcaggtgcttccgtcagctagagggagacctgatgccacagcactgagagaccctccttcagacatcctcacccacgctttttccaagcctgtgaccttcagagcaagtcccaggctctgggggactcccagtcctttggcttcttataaaacaaagtttcagatcccgggaggcccaggaaactcaaaacactacaggcctgagcctgagcctgagccgtggggaagctgctagcctctaactgaggcccagtctgaaaccaacaggcagattctctgcatctcggcaataaaagcaacagcttcagcagtgcagaccgagcctcggtccctcagaggccaggctcatcacagcactatctcctttctcacttcccggctgtgctataaactaggacctctgatcccattttacagatgaggaaactgacgctcacaagtcaagtactaaggttaaagtcccaagtaggaggtcctgggatgcaaacttatgacctggcaaactccagaaccccagaacccaattctttttttttcttttctttctttcttttttttttttagaggcagggtctcactctgttgcccaagctgtagtgcagtggtgcaaacacagctcactcactgcagtcttgaactcctgggctcaagcagtcctcctacaccacaggtgtgtgccactcgtgcacagataatttttttattttttttgtagagatggggtctcgctatgctgcccaggctggtctcaaacagctgccctcaagttatcctcctgcatcggcctcccaaagtgcggggcttacaggccaccgtgcctggccccagaacccaattcttaaccattagactgtgatggtcttctgagacattcaaacaacatgggggacttcaaagcctggagaccagggaaggccggggaaagcagaactcgaagtgggccaaggcacctccatctttgttcccagccaagaggctgcatcaggtacaaaaagaccaaactatcccttagccatcatcacactgattcatatgaaccattctgagattccacagcactgggatctaggaatcaatttgatccaacagcccatggagcgctgttcattgtcactgacatctaattagatgtcattcactgtcatccacaactgataaaaaaggaaactagtggaatgatcagagaggggcatgcgcagtcagaagtcacacagcaagttcccactgagttaggcctcatcctttaatcccagggagagtcagaccccaccaggcaccccaagaacatgccctcaaacacagcatcgaggacaacattccagcaggcaccaggacacagaaggaatcctctgaagtccacgcatccttccagccaggccaatacgcactgtctgcctgccagcctgacacttgggcctttgtattttattgctaattaatttggatggagatgtctttaaaaccaggcttacgtcgggtcctccccactgtctgtgaaccaatttcattacaacagaaaccgtgttgccaaaatgagaaatcccctccttttcaggcctgtgcccttgaaggcatcttattagaaaagaccatttcttaattaacatttttgatctttaatccattacacatccctctaatcctgtacggaggtgcggctggcccacttccgcaggctggctctgggctgcacgaggctggcaatttcagcgctgagggctcgcgcacagctggactctgccgtggacagtctgcagctcccagacaccacctctgctccagccatgggtacgtccctgagcgggagccgggaacgggggcgcggcgcggacacccccggatgggccagtctgcagacgagagttcatttcattaacccgtgagccccaactcttctcggcccagaatggtttcaagcaaaggctgttttagcagatccggctcccgcaaagcatgagagccgctaggctgggcttcccttccacacgtctcctgcaacctggccacatctaaacgaagagccggtgtcatcaaggtcacggcacatgtactcccacgccatcgcctgctttggaaagcagtggacctgcctggtgaccctgtccttcctggaagattttcttcatagggttctggggacctgcccgctcccagttttcctccttcctccctgacacctttctccatctcctcagtctctcctcatcatcccatccttcaacgtcgatgtcccaaccttcaatgccgatgtcccaacctgcaatgtcaacgtggccctagacctcagctcctctgtattcagtctatgctcaccccccagtgggtgcatctgtcccagccacacactcatggcacccaaaacacatcttggtcccatcctcccccgattgccagaacacacgttcaagtaccccctcaacatctcacgggcatctcaagcttatcatggacaagccgaacttttgagccacaccatccacaccgagctgccctacgccctgacaacttctcctagcaccctgcatctcagtgagcacagccccagccaccagctgcccaggccaaaaaccttgcaggcttcctcagctcctctccttttctcatgcccaacatccaatccagagacaaactcttttcaacctacctccaaaaagaaacttgggcacatgcctgtaatcccagcactttgggaggccgaggcgggtggatcacctgaggtcaggagttcgagacctgcctggcccacatggcaaaaccccatctctactaaaaataaaaaattagccgggcgtggtggtgggcacctgtaatcccagctactcgggaggctgaggcaggagaatcacttgaacccgggaggtggaggttgcagtgagccgagatcgcgccaatgcactccagcctgggcaacagaatgagactctgtctcaaaaaaaaaaagaaaaaaagaaaagaaaaagaaagaaagaaaaggcaagaaaagaaaaaagaaactcagaatctgacctctgcttacctcctgaccttgctcccaaccccataagcttgcacctggatgagtacttggtcagccccgaccatctcttccccacacacaactagagggacctcttccagatataaacctgatcacgccactgccctgtgcaaagccctccctggttccccatcaactcagaagaaaagccaaggcacccactaaggctccaggcctgaaatgagacacttctgcctgctcccctcgacaatctcccaacctcacctccttcctttctgctccgtctttcccctctctccccctctcatctccctgacctcacgctccccccaccacctcatttcacacccccgtctccctccctcatctccaagcccacctctccctcctctgcctggcacttgctctcctccaggcacagtgaagtcccttctgtcccacagtggggaacgcctgggacactgcttccgctgctgtgcatggctctaacgccccctccttggtacagaggcctctctgaccaccccaacacagccggccctctcctcctcacctcccaccactctatctatctggtcaccctgctggccacccctagtgaaagcatgtggtgcatttttattcattgattcattttttacttttctagtgccatctccccacaagactgtgagctctgagcacagcagagactttgtcagttctgttcctggatgttcaccagcacatggtaggtgctcaataatatctgtgactgaaagaatgaataaaagaatgaacgaatgaatgaatgaatgaatgggccctcatggatcctgccagtggtgcaggctcataaccatcacagcccttcaaagagaggtcttgcaacaacagcaccgaggctcagccagcagcaatggaaaaagtggttagacattaagtagaacttcctggtgctagaagtgctgagaaactgtccatccatgagtaaatgtatagtgtgagcctggtgctagattactggggttagggggagtaggggagggagagaacctgctccacggtgggaaggagacgaagcctatgaatggctgaggaaaaggaacaagccagcatgtggtcgtcataggctctgaagggcaggataggggttcatggaaaggacaggcccccccagaagactcacgtgcaaagggtttgtggaaggcagggacagcggctgggccttggaagactgccactttggagtaggtgggaaaggggagagagggtgctctcggaggggcacaaggcataggggccaagatgcagacgaaggacaaagtgcgggcctacaagagatcatctccgggccctactacatcacccaccaacgtggctctcccagccaactgccccagtgaagcctctgttgcttccacctggcccagggcactaagacttcccaaagttgttggtggcctctgaatccagccagccaccccacaggagcctccccacggcagcaggaggccatggcttccagcccccaccttccctccctcgcaccagagcttggaggggtgctggatgctggaggagtcggggccaagggacggaggagcagagaagccaatcttcccctctgccaaggcccaaggcacctccaggtcaggccccgggaagtgggctgagaggtgttgttcaggagtaagactaagcataacaccaccgatggagactggtatcatttggctgtgtcctgtgtccccacccaaatctcatcttgaatttcttttttttttttcttttttttttttttttttttgagaaggagtctcactctctcactctgtcacccaggctggagtgcaatggtgtgatctcagctcactgcaacctccacctctcaggttcaagtaattctcctgcctcagcctcctgagagtagctgggattacaggcatgcaccaccaaacctggctaatttttgtattttttgtagagacagggtttcaccatggtggccgggctggtcttgaactcctgacctcaagtgatcctcctgcctcagcctcccaaaatgctgggattacgggcatgagccaccaagtacagcctcatcttgaattgtagttcccaaaattcctatgtgttgtgggagggaccctgttggagataattgaatcatgggggcagtttcccccatactgttctcatggtagtgagtaaatctcacaagatctgatgattttataaggggtgtgtccccctttgcttggctctcattctgtcttgcctgacaccatgtaagacgtgcctttgctcttcctttgcctttcaccatgattatgaggcctcccagccatgtggaactgtaaggccattaaacctctttttctttataaattacccagtcttgggtatttcttcacagcagtatgaaaatggactcacacagagaaaattcagctcccacataccctcaccagggttctcccaagaactagagccttagccagggttctcccaagaactagagtcaagaggatccacatatggatatatggagaagtgttatgagggcctggatcacacagatgtgttatgagggcctggatcatacaaaagagatgtgttatgagggcctggatcacacaggtatagaagctggaaacatcccaccctgtgtcatctgcaagctggaagcccaggaaagccgatgctgcagttcatgtccaaatcccaaggcctgaaacccaggggagctaatgttgtcagtcccagtcccaggctgaaggcgcaagaaacaggagtgccgacgtccaagggcaggagaagacggatggcccagctcaaacaaagagaacaaattcacccttcttttgccttttcattctatccggaccatcagtggactggatgatgccagcctgcaccggtgagagccgtctgctttattcagtccagccatcaaaatgctcatctcttcccgaaatacctgcacagtcacactctgaaatcatgtttcaccagctgtctgggcagcccttagcccagtcatattgacacagaattggccatcacacctgccctgacacattggtccaagcatccttggtgaacccgtgggtcaggcacaggctcacccctgttgtcccagcttcgggggcaagggagtgccaggttctaaagttagtctatgaggcaaatgtgtcttagagtcaaagttattccccaaaactctttcctctcccctaagatacaactgctgtggcttgagatacatccatggagaatggtttggtccatacatcaagcatgtgggatgaaaatacatcttaaaaccccagagtcaaatttacctgccccacaaggggccacagagaccaacacccgagggaacagcagattctcacccacatcacaggttgtattagtccattctcacactgctatgaagaaatatttgagactgggtagtttataaagaaagaggtttattgactcacagttccacatggctggggaggcctcagaaaatgtataatcatagcagaaggcaaaggagaagcaggcaccttcttcacagggtggcaggatggagtgagtgctgagcgaagggggaagccccttataaaaccatcagattggctgggcactgtggctcatgcctataatcccagcactttgggaggcctaggcgagtggatcacctgaggtcaggagttcgagaccagcctggccaacatggcaaaaccccatctctattaaaagtacaaaaattagccagacatggtggtgggtgcctgtaatcccagctactcgggagtctgaggcaggagaatcgcttgaacccaggaggcgaaaattgcagtgagccgagatgccaccattgcactccagcctgggtgacagagcaagactccatctcacaaaaaaaaaacaaaaagcaaacaaaaaaagccatcagattttgtgagaactcactcactgtcacgagaacagcacgggggagactgccctcatgattcaattatctccacctgttccacctgacacatggggatttgggggattacaattcaagagatttgggtggggacacagtgcctaaccacatcgcaggttccctgagtaagccagctcctgttgactgcaattgccaatccctttacactgttattgtcctcattttttggcaaatgtgcctatctatgttgaaggaagttaaatgataaataatgacctgtacataggcatatgttgttgtcagcaaagtaaagggtgagtggaatctgtgctatagtgcagctctgccacaaacttgctgtgtgacattgggcaagatgcctagcctctctgagcctcaatttccacctatgaaatacaagaataatgataataccaatggtcaaagtgcgcccgcaaggactcagtgaggcaatgcctatggaaatgcctgcttgagggaggcaaggaggcagagtgacaaccacatgggccttggggacagtgagctgagtccaaatcctggcccagccatttaccaactggctggccccaagtctctgcaagagcatgcaaggaatgccagcacagacatgcacgagctcaagggcagaaccacaggagcctacaacagtcagctcccaaagcgaagccacactgtgcagctatggccctatctgagctgtggccgtccctgatgggtgagtcctacgcagctctttcccaggctccttggggtcctcaggccctgtggctttgcagaagtcagggactgtggctggaatcccaggctggccacctctctttgcttcctctttccacgtttggagaaggcatttcctccccttccagccctgggccagtgggtcaggtttccacccagatggaaagtcccacccagggcccccagaggacagctcaccatggaaactccacagggcacccgccagacacggagtaagtggccactggcaggcctaactggggcaggctcccagtcctgcccaccaggagggggaggtgggcaggagagggagagggggctccagccagactttagatctcagacacagaacaacgttcctacacacgcagagcaaaaagtgggtgatcgtgcgtgcatgcaggtgtatgcatgtgtgtgagcatgccctgagccctctacgcattctgagcctcagtttccctaactgcacccctgttggaggctggattggactcagataagatgagtaaatgcaatcatccagtaagaagtaagcaacaggtgggtgggctctgccagatgaagacccccaggcctatcggaataaaccacagccaaatgacagtctgggcaaggggaggaggggacaccgtgagtgaggtgcctcccatggtgttcagttcaaaggagaagcacataaacagagcttcccaaactgtgttccaagattccgggcttagggataggtggtagtcaaaaaaagggatgaaggacagattctgagcccaagagttttaagaaccctctctatgactcaaagcatccacaggcatgttgagggcccttggagatcctgccttaaagaaacccattcaattgcacttaaccaggcacttaggaaagttaccccagcagctgccccaccagcccccagacgcagcccagcaaaggcagcattgcctccgcccagctccctccaggctgtactgcatggaactccagggttgtgtggtgcactgaggcacggagcatttttccagggtcaattgaagaaggaactctaagaaagatgtttctgcatcgtgtgccaaattgttactgagatggttcctgctgtttgtccattgattaatgaggatccacagaataaattcctcagcattccaagccagggggaaaacactggtctgtcccaagctcttacataatacagaagcagctttgattctatttctctttgggccttggctgccaggaggctcaaaggcatcctgacccttcccttaggttttgacataattagtctcttcaactattatttgagctccccactgacccacaggccacctcgacagcctttcattagtaatcatcacagttagcacttattggggacatgctgtgtgccaggcaccatgctggacacatgtcatgtaccctctcacttgtccttataatggtgccacaaggtaggggctttgttattcccattctacagatcacaaaactgagctctgggaaggtgcaatcactgagtcaagcccattctcacagtgaatacacttaatttgtgctgtgtgtgttcacctgcccactgctgcctcctcactctagaatgtgagtcctggaagtcagggacccaactgtgcccttgtggcctagaagcacacagacgcctgacaatactatgatgaataactggtggtgaatcaggattgaaataagggcctatctgcctgaaaacccatgcccttaacgctcgtgtctttttggtctgcagggtttggtaaacctaacgctaaacttaaccttcagtgtaaccctaaccctgataaccaaacctatgctaacctctagcataatcccaaatgaattaattaataagccatgaaatgctccctgcctgaccctgtccttggctctgtggggcaagggctctgaacacagaggcttgggccatttagggagaggagatgcaggagctcaggtgacagcatagatggactcaatgaagatggtgggagcacatggagtcggcagcagggagagggcagcggagacggaaggctgagtttccctcctgggaggcctggccagacctgagtagggcagaccaggccaagcggagctggagcagcggtcacagaacaggaacgctgagccgacccccactcccaggagcggctactctggcctgcgagggccagcccagcgggtggggaggcgatgccctgcccagcttcctgccccattccaagctggccaggagccccacagccagcacaggaaataacaggggcccccagaggccgcccaggcaggccctgctccgaggccacccggggagggaaggaggccattgtcggcctttgtttcagtttccccagcattacccaggctccaagaggccactgggagctcacaaagcttccccccaacctgcagctgtccagcctcccccagccccgaccctggggacaggcctgccaggcccctggtctcttaaagaggcaggtgcagggtgtaaaatgaagtcacatgcaagttgggggttgcggggcggcccatgcaggccacagcaggccaggcaggcgaacagacagatgcaccaagactggggtctaggtccacaccagggtcagcccagcactgggcccaagtgcaggggtgcaaatctttggatggaaagaatgtctagggccctgagggtacgacaaagaaatggaagaaagaaaacagagcaaggagacaatctggacatcttgaacaccccgcctgggcactgttcctgatccttcaagggagacagcccagaaacaggctttttctgctcatttgcatgcctgggtgtggatgagtgaatgctgcatatgtgtgtatgcctctgtatgtgcatgcatttgtaagtgtgtgcacatgcgcactatgggtatgttggcagtgtgaacacactcctgtatgcacgtatgggtgtgcatctgtgttatgcatgtgtgtgcatacctgtgtctgcaggcatctgtgtgggtgtgcattatgcatatgcatgcacttggctgtgcgtacatatgtgtgtagtatggaggaacatgtatgtgaaggcccatatatgtgaatgtgtgtattgtgtggagtatgcatatgccaatgtgcacatacgtgtgtgtttacatgtgcatgggtggtacatgtgcattgtgtgcaaatgtgtacctacatgtgtgtgaatgtccatgtgcattgtgtggagtacatttgcactgagtgagagtatgagcatatatatgtatgaatgtgtgcatgcatccttgtgttggtgtgcatgtaatatgtgtatgttgtgtgtgcacatgcatgcacacacaatgacttgtgaatttacacatcaccaccaaagagcactcacaggtttttgcccattagcaatcactcattcccacactgaccctggtggcttctcactagtggtgtgtcgctgcaatgacattagggattacagcacattctagtgcccgtcattccaccaagatgcagtaagtctccactgagtcccaggcactgtgaattagcaactacagaaagcgtgccctagactcagacaaaaccccaactagctgtgcagactggactagtctctttagctctttggcctcagttgctcatctgtgagacgggaatgctaatactgtggttaacaaggcttaaatgagataatgcatgtcacagccccctgtctggcaccaagtggatgctcactagatggttattattttttaattgttattgttaagacagtgataattgctgaggatacgacaggaagcaaacaggcactgtccctgcctccacaagcttgccaggtttgcaaggcatttagccttgataagtagaatagcataagtaaaatatatcatatttgccagactaagcatgagtctgatgtgctaactatcacgtatggccagcagccatcagttaaagcaatcaaccatgacaaaggagaacaaattatcagtggaggtaaaataataattttttgaaccagagaggcatcagatagccaggttcagcataatctcatgtgtgtgagagtgtgtgtgtgtgtgcgtgtgtgtgcacctgcctgcacattcaagaatgttaagggaatgtcagctgacatgacagcagcctaacccctgtgggctgcctgcagtctacagcagggcaccattgaccatatccaacccaggagctgggccctgcagagtgtccacccaggaagccaacacacgccaggtggtgtggtcaagctgattttggccatttcctaatgggcactggcccatggccgcacagtccatgtgtccagccccacccaaggaaggaacctgatctcaggtcagcctcaggcctctacctttcagagcagacccagcccacctcccaccaacccccaccccacctggccttccccacttgggaaacaagccatgcctcaccaaccacggtgaacaagaatggttccctacagactcagttccaccccaaatctgcaggaaggtgaagcggattgccccaggcactgtggccatgcccagagattgccagtcacgatgtggggagaaaggcaggaagctgtgacgatgtgacgagaaggaggggcccatctgagccttctctgtcacccatacagacgcaaagctcagagctaagctcctatggcacttccctccacatggtgtcaatagcaaaagtaaaggtacagggtgccaggtggcaccttaggggttgagcactccatacggatttcccgtgccatcctcacaatggccttaggaagtagaattattattctccccatttccgatgagaaaatgaaatgacagggaggtttagtaacttactccatattgaacagctaataagtatctagacctcaaacccagattttgctctaaacaaagtgaacaaaactcaggccctgcacttcccaggacaaatacagacgaagaagtagaggtgagattctgcatcttggcagacatttgccaggcacctgccaactgccaagccagggctgggctgtggagacacagagaatcagacttggtcactgtcccctaggagtgagcagagcatcagggagctgggtataagagaaggaacattagaaccaagcagagggcagcgggagcactgagggccaggatcaggagctctttggctcagggggcacaaaattatgtcagggctatcatgggaaacttcctggaggaggtgtcatttaggctgagcttcaaaaaatgccaaggggacacacacagtctatggaccagcagcatcaacatcaccctggagcctgttagaaatgcagaatctcaggccctacccagacctgctgagtcagaatctgcatcttgacaatttgcacacatgttcaagtttgaggagcactggtgcaaaccaccccaggacgcacaaggctgggcaacactggagggagcaggatgggcagcaactcccccaaatgcatgaggagttatgccattggcaccccaccccacacaccccaacccacagacatgcctgactgtttacaggcaggcttcaagtcgccaaagaactattgatttccagtgtccaccagcaggacagcgggatccttggggacctaggaaacagccaacaccaaagagaggcctttccatcctcagggagcaccccagctttggagaaagtaggactggcccctccttgtctttacaatcctcattactgaagtcccccgaaaagcccaacagcaccaggagaggaggggcagggccatgggcttgctggggcagatggtcccaaatcaactgagcaactgcgctgcaaaatctcaatgccaggccagggacacgagacaaatgacagcatccctgccatcagggaagccccaagtccatctcaagtgggtggaaatcagcaagacaagcctagctccgtggaagcgaagtcatcagccagggtagaggtacaggaggaaaacaggagtcagaagacgcactgcacacgtgttcatttccacatgtcctgggtaccagcacacttgagtccagagcacacatgtgtacatgtatgcacaggctctgcatacacatgtgcacagcaggcatgtcgacgaggaagccaagtacagtggagcccaatgggggccccaaggctggtgcagagccagaggaaaagggtgggcaggaaatgccacctcctcctcagagaactggtccaaggcagccccagggagcccaggatgcagcacaaaccagcaggcggagcacaggggtgctggagcctccccctgccaggggtccgagtcagggctgcagctacctgggcatacttacacacaagcacacacacaagtgcatgcatccgtgtgcacacaagatacagaatgccctaccccatagactgctcaccatggtaacagagtggccacctctcagctccagtcaccacctgacgatttctgaggccccctgtgctagagggggagcagctctaacaaaggcgcagcccgggctgcctggccaggggtccatggagccaacccgccagcgcatgcctgccacgctcccccggtgagctcagggccaccgcgtcttcctacccagcctgcctggctccacttagctcaactccccacaggctccccagccgagctaatgagaaactccccagctggccccatataaaaatgcatttcataagtctttaaaatgctgggaaattctacatctatttagtgagacttttttgctcctttaaaatgtcccttggtcctcatcaagaagatgattgggttgagggctcaagcacaaaaggtggacgccaccagcacaccagccggaagccaaagggcgcccaggcagcatgcaccacgggccacagccaggcagctccaggcaagtatcgtgggtgggtgggacatcccacaggtgacccaatgcaggacggtcacttggggaaatgtgtaaagtgagacccagcggggagcaatggacagagaagaggggaacagtctctccagccttgatttggggattgaaagaaaaagttagaaggtgctgggagcccctgagaaaatctccaaaggagaaaaaaaaagaccacccacacgaagatgttcatcatggcattatttacaacagccatcacctaaagcagtccaaacgtccaacaggggagaggcggagaataacattcatgcccatccactcaagggctccagcacagacactaaggtgagaggtacgtgggtcccaggatcacaggaagctcaggtccaacagggactacagggaaacccactgcgagttcagcgtggacttcatctagaagcttatagacgaatggagctcgaaaggggactgggagaaatgcaaacgcaagtgcagaagcgcaggggtgtgggtggagtttctgtgaagctgttgaaataataactatgcactccagcaaaacacaagcagggcaggaggcagctccgcgtggttcagaagtgcaggcgggactgcacggagtggcctcgcctccccatggtgaaaggcccgggcttctggacatttctatccatttccccagccaaaacctcggggcaaaggactgcaggggatgaggctgtcgccttggtcaggagcagggaccctgaccattctcctcaccccaacttttacccagaaccaggctaaaagaaaaatgggaggcttcaatgcattcttcccaaggaggtcccaggacaccagctaccccattgccagctctacctcccatctgagcaggtcccagagactgcagccttatccccaccttcccctgcaaactggccccatgcccaacacccagatgtggaaggagggctggggatggggctggaggtggtgtgagtccctgcagagagcctggcccagtgttttccaggcctggctttgaacatgggagatgtgtgcaaggtcttcaaaacatgtacctcctctccttccaggcagcaaatcctgagagctggctgcagtcagactcttctacctgacccaggagtgaccggggcacagagctgattccagagagtctcctctaaaacaaggcatgggacccactttctcaccggcatgtctgccatctacagttgaggcactaaattcatgcatgagcggcctgggttcaaaccctcactctgccacttcttggctgagtgacctagaaccaagttatagcatctctgtttctcggttttctcacatgtatgtgaaaagcactggaaaggagccctggctcctagaagcacctcgtaaatgggagtgacggttcctattaaccagagcaagaagacctgtcccatggcaggaaagcctaaaagtctgatcacagtgcgacaccaataaggtctcaggctgcgggtccatcacggtcaactgataatactgagtgttcctctcaaaccacaagtgtgtctgtcaccatgccagaaataaacttacctaacctgcccaggcattcacaagaagtatgtgtcagcaaactgtgtcctatctctggcccatccacagacccttctcctactgcctctccctgctgctgttccagagctgctatgctggatggaagccatggagcagactctgcccaaccagtcccagaacccagcctggagaggtgggagattccaatgagactctgactagacaattacataaaaatgacccccttacccacttcacgctaagcatggtggtacatgcctgtaattccagctgcttgggaggctgagacaggaggattgtttgagcccaggagttcgagaccaacctgggcaacatagcaaggccctgtctcaattaaaaaaaaaaaaaaaaaaaagatgagcagcttcagctcccagatcaaactcagtcacagggaaagaggaggtaaatttccacatggtcgtgttggttccctgaaaccccacatcatagacctcaggatcacgcatgatgtttctggtgtctgccacttagagacctcattccaaagggcttgtgggaagagggaggaaatgctgaaggtaagatgtgtctccctgccaggctgggatgggcgggagagacaggggttaggggtagggttagggttagtaccaggctgggatgggtgggagagggggtgattagggttagggttagagttaggattagtgccaggctgggatgggcaggaaagagggggattagggttagcattacagttagggttagggttagtagcaggctgggatgggcgggaaagaggggcgttagggttagggttagagtagggttagggttagtagcaggctgggatgggcgggaaagaggggggttagggttagggttagagtagggttagggttagtagcaggctgggatgggcgggaaagaggggggttagagctagcgttaggtttagtagcaggctgaaatgggtgggaaagagggggggttaggtgtaggggtaggtttcgtacaaggctgggattggcgggagagagggggggttagggttagggctagtgccaggctgtgatgcgcagaataaaggggatttggagacgttggtaggagggaggtcaaaggcactgggagcctttggaaggctgacgcttgcagatcacaaggtcaggagatcgagatcatcctggccaacatggtgaaaccccgtctctactaaaaatataaaaattagctgggcgtgatggcacgtgcctgtagtcccagctactcgggaggctgaggcaggagaatcgtttgaacctgggaggtggaggttgcagtgagccaagatggtgccactacactccagcctggcaacagagcaagactccaactcaaaaaaaaaaaaaaagaaaagaaaaagaaatccatgagttgtccagaatgagataccttcatgcctactaggaagtttagaatttacaaaaaggaaaataacaagtgttgacaaggacctggaaaaagtggaatcctcatgagcagtgggaatgtaaaacgcctgggaaggtctggtggctcctccaaaggttaaacataaagttgccctataacccagcaattccacgcctacaaacacacccaaaagaaataaaaacaagcgttcaagcaaaaacttgtacattgccaggtgcggtgacacacacctgtagtccccactacaaggggaggctgaggcaggaggatcccttgaggtaggagttcaaatccagcctgggcagcatagctagactccacctctaaaaacaaaacaaaacttctacatggatattcacagcagctctattcacaatagccagagatgaaaacaaccaaaatgtcaatcaacaatacccaaacaaaatgtggtcctcccatacaatagaatattatacagccctaaaaaggggtgaaggacagacacctcctataataacatggatgaaccttgaaaatattaggctaagtgaaagaagctagtcaatggagattatgtattatatgactccactgacaggatgtccagaataggcaagtctacagagacagaaagtggatcagccaggtgtggtggctcatgcctgtaatcccagtactttgggaggctaaggtgggtggatcacctgaggtcaggagttcaagaccagcctggccaacatggtgaaaccctgtctctactaaaaatacaaaaattagtcaggtgtggtggcacacgtctgtaatcccagctactcggaaggctgaggcaggagaatcgcttgaacccgggcggtggagattgcagttagctgagatcatgccaccccactccagcctaggtgacagaatgagactctgtctcaaaaaaaaaaaaaaaaagaaagtggatcaatggttgcctggggctgggaggggtaggagggcaggggtgatagctaaggatacagtgtttcttttttattatttttttctttttcttttatttagttagttatttcagaggcaggcaggcaagttatcactctgtcacccaggctggagtgcagtgtcatgatcataactcaccgtaacctcaaactcttgggctcaagtgatcctcttgcctcagcctcccaagtagctgggattacaggtgcatgccaccatgcccagggctattttgtttttattctttgtagagacaggctctcactatattacccaggctggtctcaaactcctgggctcaagcaatcctcctgccttgacctcacaaagtgctgggattacaggcatgagctaccgcgcctggtccagagtttccttttaaggacatgaaaatgttctaagttgactgtagtaatggtcacacatatctctaaatataccaaaattcactttaaatgggtgaattgtatgatatgtgaattatatctcaataaagctgtttttaaaaagatataagctgggtttgtttgtttttatttttttaagaatctaaagatttcttatgaaaatccagctttctggcttttcttttaaaacctctgaagatctggcaactctggacccagccagaattctggcaattcatggcccagccagcaggagctgagggccagccatcccctttgcaaggtctgtgtcaccatccaccacggccccctcacgtatcagcccacctgggccactagcctgccttgggtgggcctttgagtttgtgaccctggcaaggttttcccatttgcaaaggactttcacatttgtaaggagttcacacctatggcctggcaaggcaggagaagttggggttggcaggagaagaagaatgacccacgaactcccctgaagtcacacatgaaaccctgtgtgtgtccgaaagagaatccacacagttccactggatgcccaaaggcacctgtgactcaaaacaggttaagaactcctccagctccacacctccaaggcacccccacatcttgactccagatgaagtgctccttcccctgggctcaccattagcagccccattcaccagcaagtggcatgagtgggcctgcgcactccgctccccacgcccccgcctccggactgcaggatattgccatgagctgatcatttcgctcctttccctgccaggcaaggccaggctctccatcactgtcagggcccccgctcgagggcacggaaggagcaagcctggttgtttctgggggcggagggccacagggtccccactggcagggtggccaggggaggccaggggtgagtgaagacacaaactgcgcattctgcttctttattgcagttctccatcacacacccaaggctgggaaaagcaggggagaggaaggcgcatgaaaagcttgcgctctgggccaagagggccccccaagaagaggggctgctccatgccttacagctctcccttcctcctggtaaactgccctcagcccagggacattgggggcctgtgagcaggaccacctatgccctgcagccaccaggcctgtcttgccagggaccttccagaagtccccataatgccctgccttcaggtcctgctcagctctccacctcccgatgccaagtggtgcagaggtgaaaccacaggctctggcttctggaggacttgggttcgagtccctgatccacagcttgccgactggggaccgtggattcactactgtacagctccaagctctttccctcatctgtcaaatgaggatggggattctcagtagcagtgccaaggatggcctgggaggttttgctcccccataatcttctttggcatctgctgccattctctgatgtggccaagtgacattttctcagtttaatgaaaagtattagacaaaagcagctttcaccaggcctttggccctggtgtcaaccagatggctgtccctaaaccaagcccacagagaaattatggagctgctgctggaagtggcacccacctcacagagctgtcacgatggctcagcgagatgctgcaggtagagtcttcactcagtgcctggcatgcactaagtaagtgctcaataaatgtgacatcgcccacgtccagggctacctcccacactgacttccgcctgccacccaggcttggagccgtctcacacgcccagtgctcagggaataaaagctgactttaatagcccaattccaatagaactgggaaggaaaatttacacatgcacagcacaaactattaaaaaaaagaaaaaaaaagaaaaaacaccagcaaaaatgagccaaagaaaacaaaacaattcctggcctggctgtctggctgtggattatccactgccagggatgctctgccctccctctccccatagctgagcagagaatccgaaactggcaccgtggcgagccacggccatggagtcacaaggagtgtgcatcctcctacatgcacgaggcatgctcagctcttgcctggaaactggcaaatcccacagctcccactactcccaggcaccccagagaggccctaagactggctgcccaactatggaattacagaactacagaacccagttccctagcaccaacaccacccttgccttctgcaagctgggagacacctcactgcctaggggatgcagctggggtgcttgacaccccccctgcccagggctgtctgtctatagcaatcactgccagcaccctccttgcacgccactgctgttcccatctgtctgcatcacctccagccccaccgggaaagcagctgggaaggaggaccttctgtagacaacactgggctgagtgctttcctagttcaggggttcctacagtgggatcctctctagagcgggcagcaagcctgagcccctgcacccctcgtctctcaggaggactacatgtctgagacacggcgccttatggccttgctgtttccgccaaccatggggaacgcactccccgcacagaaggagacacacggggggctacacagccccttcccccagcctcctatctgcccagtgctgaccccaaggcctgtcctagtcctggaccctcctccctagaatttgagcaccacttaccacgttggcttcagacaaggcccctctctatggaggaagcccctgtcaccaagggccagggcacctgcagccacaacagtgcccaagcctgggtcaaccaggaccctggagactctgcaggcagcattagctcctgctggaaaggacacggaaccaggggccacaggcttgggttcaagggcttagtctcctttcccaaatttcattgaaccatcttcaagcttcccgctgagtctccgtattctgtactattaacactttcttgtcaactcagttttttcacttaaatgaatttagcatcatcgtaagtcacaaatgtctataataccacacattagacacataaccatgaaaacattaaatgtttatatacctgatgcctaaccgcgtttctgaaatactgacccagagcaaatctctcttcctgcttcagtttccacaactaaaagaggagaagcttggactgaatgttccctcataggcctcctcaggccttaggattctgcaagactgaagcagctccagctcccccacaaatccagaaaaagctggtcaggatcccagggcaggcctggcccaaggcaggggaggaggacaaggaaggggatcccggcgcctgccggacagggagccaggggcatcactgccaagagaggccctggctgcatgaggagcaaacaggagagcgtgggccctcattcaggagctcccaaagacctctcaaagccagttctaatctcagtactcatgggaaggctccaagctacaaaacttcacagtcagaaaaactttactcatccacctctttttacagctaagaaacagaggtacaggaaagagcttatgcggggatcctgactgtcacgtcacccccgacaccccacgagtctgagctccctctattacctctccctggaggcatgagctcagctctgccagccctgagaatgcagagcagccccttccagggagggaaagaggaattctgatgtagactggagtttaaaagtcctattaaagtggcttttatgcaattagattggaatgaatgtgcagtgacgcccatagcagggagcttcaaggcttgtgcagtgggaaaatcactgcccatctgaactgtagccacaagaaggaaatgtggccctcgggagaataagggaatattagtctccgtatgtaatagattttattgaccatatggaactgatataaaaatcgtgttgcatggggtagtctggattggaggcaggaatgtgacacgaagaatatcatttccataaccagctgggtggctttctgagttcctgggccagcccccaggaccccctgcaactcttccaccagcccccgggcatttacctgctgctgtcacggaggaatcccaggccagcgagaagtctgaggcctccccctcttcaactgaaagagagaacagagatgggcctgtgagtttgaaggctgtacaaatagatcaggtaaggcacagggcgaggaagaaggaacatttgtgggggtccttattataatacccatcaccaggggagagggggcaaagcctacaaagaggcctttattggtttcacagagatgtaaaatgatcggaataaaacaggaatagcaagcaagttaagtgctggatcagttatggtttccccagccctgtgcccctggcagacatcactaatcaatctcagcactgcctcaagaaaccaataaggttgctctcagagatcagcaaagtggtgagtgctcatgaccctgctgagacctgacccacagatagacctcaggacacgctgaggtcaactctcccaatgacagcacgtctgagcactgcaactcatgagctgacaacatcagaaggcaaccagcctcccccccattccacccaggaccccacagaaccaagctgggcagagatagggtgtccccaccatcccacaccccaggacataagcccaggctggtagaggccatgcactaggagaatatgggagaaacactacacagcataacaacactcttgtcctggaattaatcccagtctggggcatgtaataatattaaagctgggttatggactttgtaaatggaactttgtttaagccaaaaatgtgcatacacagtatttttcagatttaatggcctttctagctctgcatatgtgcaggctgaagccaccatgaaccacccagttctctctgcactgtcgatgttcttgctggcaccacgtgggtgcacactgagccaggcactgtgctggggctttgcagccatcactgggtttcgtcttcctcaacggactctcagaggggtgtctgaggtcttacaggtagtgagagccacgaagagtttgggctcaaacccagggttgtctgtctccaaggttgctttgaaaaccactgttgaccggggtacaaaggatgctatccagaaccctagcaactcaggctggagggcagtgaccccaacccaccacatggaaggcatgtacaacacgcaggcagccaccttgcgagtggagcaagcaggctggcttgtggtcagaacctgagttctagcgcaaggcacagcccaccttcaaatctcagctctgcctcttactagctgtatatgacctgagcaaatgatctaacctctgggtttctgttttcccacttcaaaaatggagaaaataacggtacctaagccatagggctgctgggaggattaaatgggataacgtctgtgcagcattgggcactgtgccggcacagggtaactgcccccataataatgtcagggctgtcatctgctagaacagtggcccaaccaaccgagtgggggtcgatgccacaactcaaacagtcctgctctacgtggtgctctacatggtgcaatctacccccttgactatgtaaccatggtcttcctcctccccaaagcctcacagaatgggtttctctgaaccctgagaaacagcacatgcaagagggaacatccacgagcaactagccaaggaatgctaatgaagtgtgctctcttttccaagcccgcatcctgagagtggacaggcaggatcaagacaatgaaatgcacagataatttgagctgggacccaagctattgttttacttagctagttacagctggggtgggttttcaaatgtgcagctttataaatagcaatcaagacctcgtgtcagacaaaattgatattattcactaaaatgattccaaccagacagcctccaaaacatgggtggctaatgcctaaagccatcagaagcgggccatgcacggaaggagctgttgttaacagcattcaatgctatgccaaaaaatcagtttcccttacatttcatcttttacttacacgcacacatgtaaatatatggtgcttctattaagagactgctgccagtgtgcaaggttaccatgctgccattttgttagacaccttccacaaggtctccatgggtccctaaaccttaagaatgacgtaaaggtatatgagctgataaagaggtcagatatgttaaatttgaaagaaaaagcacaaaaaatatgttcagcagaatcccttttgagtgcattaaaaagacatgtccagggccgaacacagtggtttatgcctgtaatctcagcactttgggaggccaaggcaagcagatcacttgaggtcaggagttcgaggccagcttggccaacatggtgaaaccccatctctactaaaaatacaaaacttagccaggcatggtggtgcatgcctgtagtctcagctactcgggaggctaaggcaagagaattgcctgaacctgggagctggagactgcagtgagctgatactgcaccactgctctcagcctgggcacaacagaacgagactccatctcaaaaaaaaaaaaaaaaaaagaaagaaagtggatcggtggttgcctggggctgggaggggtaggaaggtaggggtgatagctaaggatacagagtttctttttgatttttttttctttttcttttattgatttagtcatctgcaggtatcagggcattaatacatgaccccagttctcctctgacctctgtgcacccaggtatcaggacaaatagtctgcacacttacacccactcaaggtggtttagttaagaagtgtgaccacccaagtcactgaacttgaggatgccccaaagatgtcaagtcatcctcttaggaagatctggcctcggccataatgggaaagagaacagggaaacacccaacattttggagctctgggggaaatcaaagctctgtgctgggtcccagaagtccagacaggcctgcaggggtggaaagaggaggaaagtggcccagtgctaactggctggggaggtccagagtggcagatctcactacaggcttcctggtccctcactgcaagcagccgcatgacacaatgcagtccctggaaccacatccctgtgtggtgagggatctgtgggtcaccttacttacgacttgggtgttaatgcgttttcctacaactgcaggcaccaccccactcacatgccctcctctagcccatattctgttttttgaaggtagaagcacaccttcaaaggtgaatatgggctagaggattcaaaaaacagaaaaacaaaaacagaatatgggctagaggattgttttatgagacaggctcatgctctgttgtacaggctggagtgcagtggtgcgatcatagctcacttctcagtcttgacttcctgggctcaagtgatcctcccaccgaagcctcctgcatagctaagactataagcgtgtgccacttcatctggctaatttttttatttttatactttttatagagacaaggtcttgctatgttgctcaggctggtctcaaactcctgggctcaagtgatctccacctcagcctcccaaagcactggggttacaggcatgagccaccacgcctggtttttatacattcttgatgagaaagagtcaacacccaaccccccaccacccccataaggccctgtgctacccagcaatgagtgtgaggtttttttctccccacagctgcactcttctgtccagactggatctccagcaatggcatcactaagcaggggcagcaggcacagaggaaggagggcccgtctgcaactggagctggggacaggtggccccaacccacactggcagcaggcactctctgggggcccaagcagcgagcccccaacatccctaagagggagttctgctgccgagccccactgcacactgaagactcgcagctcagagaaaccccaatccgcacaggggccgatagggacaacacaccaaaggggctacttggccggcccgcggcgcctcctccagacgtccctagctccatgtctagttgtttaatgtatacaataattggccccactgaagccaagagatacacaccccaccctaccccacttcaaggggaacacagtactcctgtggatgatgggcatttgtaaggtaggtgggtggccagggtgtgcccacactggagggtgcacagggtataccggcatagggacagcacgtgaagcaagtgtgtgcacacagagaggaggcatgggggcaagtgtgtgacacagagcagaggcataggggcaagtgtgtgacacagagcggaggcatgagggcaggtgtatgcacacaaggagggcatgcagggtggatgtgaatacacagggagggggcacatggcagagcccgattcaccacgatgctaatgaagccccagctccagagccctttgcaaactcaagcccctctgcacactgggaggggtcccagcagtggggttctgtagccctacatgttttgtaacctttgcaaaggaaagatctgttacctacttaagacctctctgtctctgtctgtctctgtctctctctctctctctctctctctcgctctctgagatggggtctttctctgttgtctaggctggagtgcagtggtgtgatcacagctcactgcaggcacaacctcctggctaaggtgattctcctgcctcagcctcccgagcagctggagccacaggcacatgccaccacgcccggtggatttttgtagttttttttgtttgtttttgtttttgtttttttttttttgtggagacaggtttttgccatgttgcccaggctggtcttgaactcctgacctcaagcaaccctcccaccttggcctcctaaagtgctggggttacaggtgtgagccactgcacctagcccactttttctatctactccaaactctcttccatcccatttcctctcctgtcggtcaccttgagaatggccacaggcattttgcactctttgtctcaaaggactcccccagttgtttcagccatacggccccccacacaagctctgtgctggggccaggcagtggacttcgagtaccctctgttcaagcacacgtgcaggcatgcacacgctcatgtgtgagatgcagaaaggctctggagtggcccaggtcacatggccaggctgcagctgcccactcctgccccatggtctaccagctcctgctcgtgattcccagacctgaccttgcagggcagcttccggcttagcccctgctaacccgaacacctctcattattccttccacctattggtttcctaggcttttatctgcctccctcactagggcatggacaatgcctgtcttgttcattgttgtatcccagtgcctagctcagtgcaaacatagtagcaggtgctcaacaaaaaacaaaaattttatttttggaaacagagtctcactcttgtcacccaggctggggtacaatagtgtgatctcagctcactgcaacctctgcctcccaagcaattctcctgcctcagcctcccgagtagctgggattacaggcgcttatcaccatgcccggctaaattttgtatttgtagtagaaacggggcttcaccatgttagccaggctggtcttgaactcctgacctcaggttatccacctgcctcagcctcccaaagtgctgggattacaggcatgagtcactgcacccggcccaaatttttaatcaataagcacacaggatgtgtggtgacatcccagagggcctgcagcagggatgggctttgttcagaaccaggcagtgggcaaggcagccacagacacacctgtcccctccacgccaccactgtccccaccccatcacactagagtcacaccagctctgggagcagaaggtcacacatgccaatccagctccctcatggcgctcacacttgccccggccttgagcacaaaccactcctgcctggggtcaggcaggcactgaacagaaaactctggccacagaatccagttacagagtggatggagcagggagttcttcctgcccatgcaatgggaatcatcatcgctcatcagagatgggatccttcccagggctgagtgtgacctcaacaatcaggtggccctggaagggcccaagggcaccacagtagccctgcgaggagctcctgctaaaacacttcaccggacagggccttggaggccccgcccccacagggatggagggggctacacagggaggtaggaacgggctcaatcttaagactcccagctgtcctgggataatccccccaagctgtggagactgatgggcaacgtccagcagcctctggacaagggctgctgcagaaagcccttcaaaggagcacccgaacacatcctgttaagagaaagggtgtttgcggccatctctgaagtcctggggggcttccagttccctgtgtgagtcaagatcctcaacaatggacaagaaggggctcaaagaggccagagggcccttagagggcgcctgcttggtggcagcaggtctaagaccagctctcactattaaccatggttcctggggtgcattaagaaggattctggggctctgccagggcttcaggcagatcaggactccacgttgactctcagctctggggtcagaagttgtgggaggctgattgacgaatgggagtatagagctccccctaatgctgtcgccccaactccacagcaggtgcataagtagctacaactctcctgctctgggattggccacagctcgtcccctgtgcactagcacaggccttgccaccaccgagatcccttgtgtgccaggcctctggatttcagatatccagtggcacagagcaagtggcactaggcagacacctgcatgcaccacctcctccaggtcacttgctcctggcctggagagtaatgccctccacccagagggctccccaacacctcacagaggcagaagagatggagctggagagggaaacagaaagggaaggtgaaagctgggcatggggtctggaaaaagggcccagaacacagcagtggggcccagacagggctggggccctgctcaggagtttgtcaaagtcaggcaagatgtgttttggcagagaaggttcaggtcaaaggcaggaaagctcgggggacagattctgaggcagacagtggcaggaggtgaatgagagacaaacagaggctagtgctggtccaagggtcagaggaggcctctagtagggccagggaagaacccagaatgctcctttctgaactccaaaatccatgctggggccacttgctcagcctggcttgaaggctggaagaaggctctgggtgtgagctgctgtgcacaggcacaaaagggcactgttctggggaaaggatccatagatttcatcagaagatctagaaccacctccacccccaaaataactttaagcacccatagaccaatggctctcatttgcaaagtgttctcagctactttccccaaggccttgggaaacctccccatgctttgctggcccgtcccacccttacaacatcccatgcctccccagagacatccctgtcccagcagaggtggtggccaggcaaggggcacgtgactgcccctccttagctcaaccttagggaaaccctctcacacactgcaggccaaggccacaacaggtaaaggggacagcgagagacccaagtctcattgtcaagcatgaaacagagcatcactgcttctgacttactactgagcaacctccaggaatggaaaagcatagaccaggcagggaggccaagcaggtagagcggtataggccaagcactgcacagaaggccaagcaaaggtggcgagaaagagctgaaatgtgacccacactctgtctacccagcactgtgtcctggtgcagggctgtgaatgcccagagaaaggggtgcccattcctttgcacaaaagcatagccaatcacttttctacagcccaagatcatctttggcatcacgctcctaggtcaaatgaccagggtcaagtgcagacaaacccaacgaggaagcccacatcctccaggctcctttcaggtggcgatgtgttcaggcagtgggtggggtgggggtgattgcatgcaaaagccaaggctccctgcagctaaagctaaaaccacccaacacctccactgacaggccccttggcaccaagctcagaccatcagaaaagccacaatatgacagtcacatcacaatcacctttgtttaactcccgtgattcaccctgaccacttgctgaaaagagaacaagctgtttcaacagcacaggtaagatcgcctgccattatgccctgaagtgagagtgaaagggacaggaccctctggctctgtctcatgggtctctctgtccacaccctgccccccaatatatgggcatctcaccaaaaggaggctgggtctagtatttaaagaaaccgattttttaggccaggcacagtcactcacacctatgataccagcactttgggaggccaaggcaggacgattgcttgagccaaggagttccaggccagccagggcaacatagcaagatactatctccataaaaaatttaaaaagtaaccagacatggtggtatgtgcctgtcatcccagcaactcgggaggctgagatgggaggatcacttgagcccaggagttcgaggctgcagtgagctatgatcacatcactgcacttcagcctgggtgatacagcaagaccctatctgttaaaagaagaaagaaggccaggtgcagaggctcatgcctgtaatcccaacacttatggaggctgaggtgggcagatggcttgagctcaggagtttgagaccaacctggccaacataatgaaaccccatctctgctagaaatacaaaaattagctgggtgtgatgatgcacacctataatcccagctactcagaaggctgaggcacaagaattgcctgaacccaggaggcagaggttgcagtgagccaagatcacaccactgcactccagtctgggtgacagagcaagactctgtctcagaaacaaaacaaaataaaaaagaagcctgttttcagacaacacaactcctaaccagaaatcttctaaccaatctagtactttttaaaaataaatacatacaattttttttaaaaaaattaaagcagaatattccaatgtgtgaagaaaaaccattgttaagaattactgatagatggtcagtgggtctccacgtcggcgcttgtataacaggcaattttggcaatgcttgactttctccttaaactgactttagaaccagcacctctggaagctgccacgctactacagactcctcataaactgttgccctggagaattgtaggcagaggggctaaaagcctaaaccttgcttagccactgtgccccttcctctccttgccttgctatatataaaatagaacagaaagacaccagggaataatccaagaattccaaaaagtaaattcatctgtccttacaggaaaagtgacccttgcagaagtcacgcagcagagctcatctagctatggctgtgaggtagaggagggaacctggagagacactataaaatgtaggggtgtgggaagtgggctctggaataggctgctgtcccccaagtgatcacttgcaggccatcagatctcaggccagagactcgatccaccctgatcttctgtctctgtaaaatggggataatcagaataccaacctcgcaggaggttggagaggaccaaatgagatgataccccaaagcacttagctccagggaaacatgcaatcaatgtgagctcatgttactgggataattcaagctccccttctcccgccaggttcctggctggctgctgaggtttcactctccctggaaagacaggagagctgagttttgagcagtgagatcaaatttcccactgcgatttagcccaccccgccccacccacaggaatgcccagctagagccacagatgcctcagcatcactgctttcctgttcccactacagtgcagggatggtgtccctaaatgtgggactatttggaggtgacagccaaggggctcagcttctgtgccagctcatctccctctcaccctcctattccccatgatcaccccaaaagagaaaggctaggagatctctgcagaagaagcagacactaaccccagtaaaatctatatcttcggcaactctgcagaaaggtgactcctctcctccatctttccctaataaaaacatgatgatgatgatgatgtgtaaaataggacaatgagtgtgaaacacttgaagttttctttgttttgttttggtttattttattttttaagacaggttctcactgtgtcattcaggctggagtgcaatggtaacatcttggctcactgcggcctcaaactcctgggctcaagggatcctcctgcctcagcctcctgcgtagctaggaccacaagcacgcaccattactcctggttaattgttatatttttctggccaagcgtgggagctcacacctataatcccagcactttgggaagcagatcacttgaggctaggagttcgagaccagcctggccaacatggcaaaaccctgtctctacaaaaaatgcaaaaattagctgggcatatggatgcacacttgtaatcccagctacttgaaaggctgagatatgagatgcacttgaccctgggaggcaggggttgcagtgagcagagattgtgccactgcactccaacctgggtgacagaatgaggctctgtctcaaaaaaaaaaaaaaagatatttttctgtagagatggggtctcactatgttgcccagactggtctcaaactcctggcctcacatgatcctccctccttgggagttttctctaagtactaggaaaagggtttttccactagacccaggacagcacacatgtggaacacctgccccagctcctctatcttgcacccaccatagatattgccaactgatcggggttctttctctaaattggcacagatgcagcttcaaaagtctcaacagcgagggttaaaatcttgggtttctctgttctggtccatagaacttccctgcaagcacctggacatgacacacacacacacacacacacactcctgcgcacacacttgaggatgtgcccaatgtgagcaggaaaggccacccttcactgagcccaagtggcatctggcacagtgccgggtatcccacatactggctccccttccatcctcccaggccccctcagagggagcccttaaaatcctcacttttctggtgaggaaacaaagccccagggagccacagcatttgtccagatgccagccacggaatcccaggccagggcagatgtttccaagcatggcttcagctcaaaggcaaaacagggaagggaaggaaaaaggggagccgtgaacacccagccattcacccctcgttctgtcctggtccagcccagccatggggtaggaaaagaaaaggaaactgaatatcacaaagccacctgatgtggcaatgttagtggaaagccagaatcaggaactgagaagaactgaagacaacatcgcaaaggcaggaacccacgtgaattaaaacaatgtcttttttcttcttctaaaacagtccctcgcagctctgtcagaagaggagccaagcctgggtacgttggcagccccgggggactgaggagagcgtgccctgccacagcctgcctctctgtgctggtcccacgtgggtgaggagacagacgccagcctggcccaggtccctcacgtccttccccaccaccctgcaccagaactgtctggcactggaggcttttacagatgtttcctcagctcctgcctgaaagtcagggctttactgacccatttcaaagaaggaagaatagagtcccaaataagagaaatagctcacctgggggcccagacgaggcggcaaaagcagactcagaacccggcattctagctttcaggccctggaatactcctggacaatgctgcccacctctgaataagcagtgaagtgcaactgagccctcacctgtgccacacactgtgatgtgcacttcggttgcacaaagtaattctcagaatatagtttccagaccagcaatagcagcattacctaggagcttgttggaaatgcagaatcccagaccccatcccagacctacaaaatcagaatatctgagggtgggactcaggaatctgtgtttttgcaaaaccaacaaatgactttgatgcgtgcttaagtttgagaacctatgagtaagtacatttattaaccccattttacagatgagaaaactaaggttaagcaatttgtcaaaagtcatggagctaggatggggtatagccaggactggatttttatttttttagagatacagccttgttctgttacccaggctggagtgcggtggtgtgatcagagctcactgcagcctcaaactcctgggctcaagtgatcctcccacttcagccccccaagtagctgagactagaggaacatgccattatacccagtcagttaatttttaatttttttcagatgcgtctcactgtgtggccaggctggtcttgaactcctggcctcaagcaatcctcccgcctcagcctcccaaagtgctgggattacaggagtgagccaccatgcccagctgggagtagaattcttaaccccttgattttacttcggcctccaacaggcagcaggtctggttccagattgagtaggatcagtcaacataggactggactctcactctctctcactctgccccgctcccatgatccttaagatccttaggtccctccctgtgccagccccaggagaccctaagaagaggagagttcatctcttgggtctccctaagcactcaaggtccttggggtgaaaccatgagagacaatggtgtgctggtcaatgtctaacagggggctatccaggagaacaagaggctctggtttgtagggtttgccactttctgcagtgtaaatgcccccactgcagccaacatcaagctaccaaacaggacactgctgagcagaataaatgtgcacgatcagcgcaccatgggacaaaggcacagtgtcacaggaggaggaggaaggagagaaggggctttggcagcctaggacgctgcagagaccccagctctcccacccaccccacctgccctgcctaggctttgcccctatgttccaaatatgtcagaaacacagaattcactccaagtggccctttgcttattgtttcctagaacaaacgtctctttctttctgtaaaagtttctgacataagtaatccatgtacaacgtagaaaactagggaatacatgtgagttaaaatgaagaaagtaaaagcacaactttccagtatgtaaatacattgttacaacattaaaaacaggtagtgctctgtattccgcttttctaactcagcagtacccagtgaacatcctttcacatcaaaaacagagaccaaggaccagcccgatggctcacacttgcaattccagggttttgggaggccaaggtgggaggatcacttgaggccaggagttcgagaccagcctaggcaacatatcgagattccgtctctacagaaaaataaaaaaaaaattagctgggcatggtggcatgcatgtgtagtcgcagctactcaggaggctgaggcaggaggatcacttgagcccaggaagtcaaggctgcagtgagttatgatggcaccactgcactctagcctgagtgacacagccagaccttgtctcaaaaaaataaaaaataaaaataaacggagaccaacactattatcaatgatggcctgagtcccatcacaggaggctccaaataaccaatatcctgttgctggatagccaggctatttccagctgtctcctcctgtaagagaatccacgctgcaacacatgtatggtcacaagcctgttcgataatattccttaggtcagaagcttgattgctaggacaaagagtgtacccatttttaggcttttgggatacactaccaggaggcatttggctatttcctcctttaacaagcactgagcacctctagactacctagaagtctgcgctaggtagcatgagagagatgagaaaaggaagctgggttttgaccttcaaccactagatggtgaatccacagtgacaagtgttacccatcactgtgccccttcaagggctggcacacaggagctgagtgagtgaatgaatgaacaaactacggtatgctggaggttgctaaatgcatcccaaactcagaacaagacaaaaccaagtagaggacctggagtgcagacacaagggaggggcagggagctagggaaggggaaaggcagagctcaaggtggggtctctgtctccatagccatagccccagagcagactcaggggtggggaaccggcccagggctaggatgagtttcttttttttttttttttttttttgacagagtctccctctgtcacccaggctggagtgcagtggtgagatctcgactcactgcatcctccacctcccggattcaagtgattctcctgcctcagcctccccagtaactgagattacagatgcccgccactacgcccagctaattttgtatttttagtagagatggggtttcaccatgttggctaggctggtcttgaactcctgacctcaggtgatctgcccatctcggcctcccaaagtgctgggattacaggcctgaggcactgcgccccgccttcagatgagtttctacttcaatcagagttaaaattctgatttttttacactaatatgcaaatcccattttcaggaagaatgataattgtggacaaaatcttaaaagtccatgggtctcttttttaatgtaagcaagttttcctgctcaaaagtaaagttcagaaaaaaatctaatcaaattgaatttaactaagcaaagaaatcaatactagaggaaatctaggtagcctcgccccacccagtctagcatcacctgggatccggcttatgaggagacctgggaacaggcccagggcttccagcttctcatccatgtccccagagtcagcctgaccacaggctacaaggccacctcctctcctggtcagaaacactgaccagagctcaaggtcacctcctccaagaagtcttctccagccatggactgaagttagttctcacctgcagcagggtgtaattgaagcaagatgccttaggatcaaatcccaatccaccatattttgctgtgtgacttgggcaaatcaggtaacacaccaaccctgtgcacaccaaccctgcaaggtagctctgaagatcaaacaagatggtgtgtataaagtgcatggttcaggacccaatacccagtgcctggcaaatggaaaccctgatcccacagcttttttttttttttttttttttgagacagagtcttacttactctgtcccccaggctggagtgcagtggcctggtctcgactcattgcaacctccacctcctgggttcaagcaattctcctgcctcagcctcccaagtagctgggattacaggtgcccaccaccgcacccagctaatttttgtatatttagtagagatggggtttcactatgctggccagaactggtctcgaactcctgacctcaggtgatccacctgcctcagcctcccaagatcccacagcattatatgttgcccacaaccatactctcagcccctttagggaaagtctctccatctcctctttctcccaccttccagttcacttggcagcagactgtgcacatcagagacactagagacaaccatcacatacctgtagtgagaacacactgagccacctcttcacacgttaccacgttcatgctgatactcccaatggccctacaaaagcaggtactcatcttacaggtggaaaaaccaggggctaaactaatttttttaagtggaccaaattatggaagcagagggagatggagcccagatttgaagctgggtctacatggctctgaagttcaccaggccatcctgcctctctcggccccttcaaaacaaacagtaattaactggccaaacttcccagattgcctgtaccttctcaaaataaggcaaagctcgccaggcaggtaagggttgaaatgactccttttttctgaaccctccagtgaccagtctgcagaggtcagtattgggtgtgccagcccacgttgatcataaactccacctgttgcttgctgtgtaaccttgggtaatggactcttcgagtctttatttccacatctataaaatggggatttaaaaaattccatttattttaaagacaaagtgaaataacacaggtaaagatctcagcttagtgcctggcgtccaacgagcaacacgaaataggatgattgcttctgtgcccccagccagtccatccagggttgcaatgtgtgcggaaaattccctttctggggaaccgcctgcctggaccttaacagggagggcccccggcctcccgggctgccctctcgtttaatcccatctctccctgaggttaatctcctcgttcatacatgtatttcatttcatacagtcatctctgcatggtctcgttaaccagaaacgtgcagcatataaacgtggatttacaatggggtctggctcctgcatcctgtttcgggggcaacactgggctctcgcccaccagctgggaaatgctgatggaaggtggtggagcggggggcaccccagccccccagggaggggccacacaacagcccacacaaccgccagatgaaagtggcagcctgtacttcaggaacctgacagtgggcacatcagcctggggcccagcccctcactcagggtatggtacagaggacccacatctgcccaggtctgtttgctgtttcgggtggaaaggaagaagcaggtaagatcggcaccccactctctttccttctttccactttcatttgaagaaaaagcactataaagtagaaactaatgtttttttacaaccccttaacagcttgtcctctgtgctaacatactgtaaataaatgtcagttcctggttatacatgtggtttattttaaacacgagcagaggaaactgagtctgtcattgaaaactgatttgtgtatgtatgacgtgtgtgtgtgtgcttccatctggttctgaacacacagatcacccatccatctctctttttacacattgctcttcttcctcatactttttttgtggttaaaaaaaaaaaatgcacagcaggccaggcgctgtgactcacgcctgtaatcccagcactttgggaggccaaggcaggcagatcacaaggtcaggagttcaagaccagcctggacaacatggtgaaaccccgtctctactaaaaatacaaaaatcagctgggtatggtagcgcacgtctgtaatcccagctactggggaggctgaggcaggagaatcgcttgaacccgggaggtagaggttgcagcgagccgagatcgtgccattgcactccagcctggaggacagagcaagactctgactccaaaaaaaaaaaaaaagtgcacagcataaaatgtaccattttagcaatgttaaacatacactacagcagtactaactccacacacattatcttccttctctttcatattaaaagcccaagccaggccgggggcggtggctcacgcctgtaattccagcactttgggaggctgaggcaggcggatcatgaggtcaggagatcgagaccatcctggctaatgcggtgaaaccccatctctactaaaaatacaaaaaattagccgggcgtggtggcgggcacctgtagtcctagctactcgggaggctgaggcaggagaatggcgtgaacccgggaggcagagcttgcagtgagtggagatagcccactgcactccagcctaggcgacagagcaatattccgtctcaaaaaaaaaacaaaaaatacaaaataaaagcccaaaccttccacagaaacgaactgtaatgtctggttccaaacactttttcattccacaaagacaccccggggtaggggcaagcacaatacttcacggcttaaggagtttgtatttttaatgtctgatttgggagggggacatttcactggcacagatgtgctcccgacttggccccattgcccacccaccgtggggagcttgcatgtggaaaaggcctttgggggaccccaggcagctccacctggcagctggtcccaccaaggcaggccctccctaatccaaacctgcctgccatcccaagacaaccccaaaaccttcactaagcatgccaaccatcccaggggccgtgacagggtctgcctgggcacaggctccagagcagcaactcagcctctccactgtccctgccccggggctggcagggacctccccagacaactcctgccaggaggacacacctctggcactcagagtcacgggatgcttttcttcccatcaactccctgctttttcttacattcctttttttctagcttctccctaagcagcgttactcaagaaatcacacatttggtgtgctagtaacaatttttctttctttttttttttcttttatagggacaaaatcttgctctgtcaccaaggctggagtgcagtggctgcatcatagctaagtgcagcttcgagctcctgggctcaaaccatcctcccaccatagcctcctgagtagctgggactacagatgtgcactaccacacctacctaattttttaattttttgtagagacagggttttaccatgttgtctaggctggtcttgaactcctggcctcaagcaattctcctgccttggcccctggaagcactgggattacagatgtgagccattatgccaggcccaatttttctaatagacaataaaataaacataagaagtaacatgttcctaacagatgaaggaataaatatatataagtatgaagaaaagagaaccattcacctatcagccacctgaatcccacaagcctccggtgcaatgtcccattttggggacagtgggcatgagaagtgctgggcacctctgataaagaggtgcatgtcagttgtcctaaatggatctccgggaacccactcagcccactggagttcagcaagggctgagtgttgcatgccaagggcagtgctgggcagaggacagtgggaggggcgggggacatgctggctacacactctggcaagcagtgaagtactcccaaaacctgtggctcatccaccccccagggccgttagcagaggggtggagaggggtggaaatcacgacaagtgtgactatttcccaagtgcacctgaccacctgcccccatggcccagggactccagctgtgcattccctacgcacaccagacagggccagagagacccaccaggctgcggcaaggctcaggggaagccaagccagaagacacggcctcagaaaggttcagcaatgggaaaggataccactgagggccagagcccctggcaggaggcacgtccccgagcagggggcacactgagcccttcctgccccaaccacatctgtctcatcccatagccctgcacggccccacacttgccagatgtggccacccgtagggaccaagttcattttccgcgtgtcctgcgataatacttggttgtgtttatttaactttctgcttcgaatggcggagagatgggccaggaaaatcagtttggctcccttcgatcaaaacatagcggcccacacataatgcgaggacacccacacagagaagctctcccacaccatcagaaaaagcacatctggtccacggctggcaggggccggcccggccctgggggcccttggaaaagctgcctcgtgcaaagcggcataggctgcagtggtcccatgctctgtgtgtcacccacactgctatgctccagcgggcggcagcaggttcaatctccccacccaggcagagaggtctcagagaagccttgtgttccactacacacaagccagtgcagcctgtgtgtagtggaactcacacccaggtcctgctggtcctggaacccccaagaaggcgagagggggactttggggaaaaggagaatccgagagaaaggtcccagaggctccgctctgcacctgcgagaacagatgtggctgcctcatcctcccatagcagaccacatgctggctcccagaggggagaggtggggacccccgggtgggttagcacagctggtaaaagcattcctgctcccacttctgatggcctccaaagtgcctccaccaagccctgaggcatctgaagcctgctcctgagactggaaacaaagacaccagggggtctggggctggagggtccacccgggagctcttagcaggacaccaggggaagccttatgaaccgcatgagagtgagagctcgcccagctgtcaggacccaggcccccagcctgcgcccacccattttttcctcccacccccagctccttccctcgaggacaggggcaaccatgtgtcaaaggtctgcccaggccccatttcctgctgacagcaccccttccccactctttggcctggggatatgcacactgaaggcttggtccacccttgggaagacaaacacagggagaggccccagaggtccagggtggtctggggtcggggaggctgggggagtcctggcacctggagataatctagaagaaagaacacgttcccagactcacagactcctcaccccaaagaggacagccagagaggggcctctgccagccccttgcccccagccctgccacacacccttcttacctcctgatgctccaagccatgcacccacctgctcccttccaggcaaccaccttcctgtctcaggacctctgccactgctgctctcattacccaaaacacccctgccatgttggaggcccccaccagacctctgctatccaagaggccttcccagatccctggataaacagacgcctccttctctggtccccataatcctctctgagggcccgactcagctgagacccctgggcgcatcagggtcccctatgctgtgagctccctgagggacagccccaccctgttcctcctccttgcccctcactcccagctcagggcctcgtctccacagacaactgccatgagttgattaaaatgaattcatcgcaagccctttgctttgttacttttttaatcttccagattataggaaaaataaataaatacaggtgagtactcagggaaaaataaaaccacctataatgcccctctcggaaatgccatgggtatttgagggcagtcggccctaccggacactttctgtgcatttacactttctctccttcaacacaaatgggacctggggcatgtctgagtggtcttgaggccctcggggtgtgcagggcagcgctgagagtccggccacaagaagttcacgggcccacgaggatgtggctaaggaggggcatcagggtaatggggggtcttgaaaccacatcttgggaggggaagtgaaggaactgatgctgttcagcccagaggggcaggctcagggggccctcagagctgtcttcaggcatctgaagggctgtcacagagaagacagactgcgctggctgtgtggcctcaaggggtcaaaccgggaccaaccagtggaaggcactacagaaagatttcaagaagaaacagatgggacgatttcaagaagaaacagatgggacgctatcagcagaggcaatgaggggaggtctgcttgggggtagtgaggctcccggcatgggaggggaccaagcagcggtagagagacccccaagaaagtcaaggctcagctaggagaggagttagagttggccttgatgggatctcaaatgatcgcaggggaaataggtaggtaccagaaataaacactgggggtggaggagacaatggcaccactctacccccaacccagcccacgctgccacccagagtgtgcttagcagggtcccattttctggtttctccagggaggccagagatctgaatatttataggaaccattccaattttaagacaggctgaccaaacttctagcagtccaaatacagtccttgcactgcaggctgccgaccccctggtcagacaaggagctcacagggcaaacgaggctactgaaagaaaagggagccatttccgggcccagaagagcagccatccccgcaggactggaatgggttaaagtctgagttggctctctgctgctccaggactacagctggcctcctacccccacccccgcccccagaggccctgtcagctgcccaggccccgcctgaccgcccgcctcagccacccagcctggaaccccagatctgggaacagggcagctgccctgaggctggccagccaccgccagccagaaagagattccgttccccatgccctgctgagagccatttgctcatctgggatggatgccacaggggcagagaagcaggctctgtcccgctctcctctccccttcctcctgcccctaggcctgtgacagggagcagacctctggtgccaccacaatcaaaactccgctgagcaccggtgactaggcggggtgctccacacacagagcacttgtgtcaccttcctagggatcctgcagggagtcctcaaccatcctcattgcacaggcaagaaaacctatactcagagaggttaagacacttgctcacggtcacacagccagcaagtggcagagctgggattcaaatccagacctatgcaatttaaaatcccacaccaagccactgggctagagggtcctggctctcccacatccacattccccatctacctggttgttttctagaagctacaggcacctgctgcctggctggctatgagaggggagagagggcatagtcaacgctactgataaaggctgggataagggggctgggcatggtggctcacgcctgtaatcccagcactctaggaggccaaagtgggtggatctttggaggcccaggagttcaagaccagcccaggcaacatgatgagcacatctctacaaaaaatacaaaaattagccaggtgtggtggcatgcgctactcaggaggctaaggtgggaggatctcctgagcctgtgagttctaggttgtagtgagctgtgattgtgccactgcactccagcctgggcaacagcgtgagatcccatctcagaaaacctaaataaatgaataaataaagtcctgaagcagtactgaagtagctgatttggaatcatttctcacagtctggaaagtgagaaagggtgaggggctgtatggtgtacttccatttgtgttggggaggggagataaatacacgaattttcatgtgtctgaacacacgtaaattgccctggaaccagacacaagaaactaggaccagcagtggcctccagggaggacagtgggtggctgggggagtttctaattttgctccttgtgcattcattagcaattcgtgtgtttaaaagtgtgtgtgtgttctacttaaaccccctgccacaccaccaggggcacccacacttgccttggggtgctgcatttttgccttcccaccttggtccactcccctagttgtagccctactaggcggtggggctttggggaagttcttgctgctctctctcaactcccatttccctgtgcgtatgaatgacattagactggacttcccccaaatccccacccaccctggtgccctacaggtctaccttggtgactccaaccccacagcccagagctggcctaacaggcaacggcgcacttcacccccagcccaccctgtgccccgactccaggcagccagagccttctgaggtggcaggacaggccaccaggagagcagtgacagccaagcagacatgttcatcctccaggtatccactgccccagcctcggataacagcagcaccccaatcgtgccctgaggaaccgcccctaaccctaacctcaatgtgccaccagtcaaaatgccctgccctcccctgggccatggcccaggctcatgcttgatctgcccagggattgatcctcaagcagagccacgcaggagacacgggaggtgacaaactcccgccccatggcagttcccggaagagaacatccattccctctcgctcccgcatctccagagctgccccaaggcctccatctctctgtgcattcacactgttggctcccccttggcctcctgttaaagtctcttttggcttaagttgtccagagttggcttctgtcacctgcaccactgaaccctgctggacaggaaaccagcacagtggccgagacagcagctgagaccatggagatggtcctgccattgcagctgactcagaagccacccaggaaaggccaaaagctctttggacaggggccaggggtccacatccgccccccaactcctataaatgccttggagaaccgggaggccccaggtgggctcctgcagaagaagctggaaaaagaaaacaagcagctccttcctcaaggacgttagcaggatttgccgaactcccactttttactcctggaaagcccagaggacgcaggaagtgacagttccagggaaggcgtgaggtcgaaggctgtgggctgccagggtccaagagccaggccctgaggagccggggcttcggagacagaaggccctgggtcaaggccacaagcccagccctcagcagcagtgggactccagacggggcctgtaatactgaaccttttcaggcatcacctgtaaaatggacatgattcatctgccttcccgtgggctctggggggtggggggatgacatccccgacatgtcctgtgcccaggatagactgcacctaccctttccaacaatggggcaggatcggagggcaagcaggacaggggtgggctgtgccaggatagactgcacctgccctttccaacaatgggacaggatcggagggcaagcgggacaggggtgggctgtgccaggataaactgcacctgccttttccaacaatgggacaggatcggagggcaagcaggacaggcatgggctgtgctttctcaggtgggcaactgaggctcagacaggaaacacgcttgttcctgagaagtacaaaattactccaatcctccaaggtcctcctgaacaacctaatcaattggcttgctataagatttgttccagaaaagttttgcaagccactattgtaaaaaaaaaaaaaattaatccgcaatgagtttacagctcgacaggcctagcaccccatttatctacctcattcaaacccaggagcatgacccaaaacagggctctgataggggtgagcctggcatgtgagcagggagccaggaggaggtggcatcccccaccccaggagtgtggatggccagcaagacggaggcgacaggaggcggtcaggtctcttctgaagcagccccagagcactggccatctcaactctgcagcgggcatctctcctgacctcctctttcccacacgtgtgtcctagaatgccacctcccaagccacgtcggggagggcagcctgctggttagggcctcagggtctgggatgaaaccaaccaggctcacagcggggctcggccgctcatcagctgtgtgaacttcggcaagttactcagactctcagaacttgagtttcttatcagtaaaatgggtcaaagagggcctaccttagtgggagaataggctgctcagtaaatttggccattcttattaataacactattattttccctttcctgccctgatacccccagctgctccaccaaaacgaaccaaaaaaagcagccccctaagcagcagctgcacaaagatctcgatacggggtcaggacaggaagttatctgggagttccctaactttccatgagaaatctaaggcacagacctcattcacaagggaagtagggggcctggcacctgcttctgcttcatcaggcacagtgggaaactgccaactcagtctagtgccccactggacagatgggaaagctgaggcacagggaagtggtatgacgggtgccaagtcacacagcaaacaggaggcagggctggtccaggagctccaggcagactctggcagggcagcactgcccagctctttcaatcctcggagtactggcaaccttgaggccttcagggccagccaggtaacattaaagggtaaggaaggcttgatgcacacaacagggagtcataggtacgaggaacagagcacgcaggcttgggtataagcaggcagcaccagcccatcctcactgtacaggaacttgatctcctgattgctttgaagaacagctagaaatctggatttttgtgcatactttcctgaattttaagtgttacattctaattccaaacaaacaaaaaaaaaaaatatatatatatatatatatatatatatatatattttttttttttttttttttttgagacaaagtctcactctgttgcccaggctggagtgcagtggtacaatctcagctcaccgcaaacttcacctcccaggctcaggcgattctcctgcctcagcctcctgggtagctggaattacaagcgcccgccactacgccgggctaatttttgtatttttagtggaggcaggatttcaccatgttggccaggctggtcttgaactcctgggctcccacgatccacctgctttggcttcccaaagtgctgggattgcaggcgtgagccactgtgcctagccaaaaacaaattttaatcctgagcagccaagaaaacaaaatgatcctgacactggatgcgctcctcgggttcccagactgcaaccttcccccaggatttcaaagcaggtcctgagtatttttgtttgtttgttttgtcattgagctaaaatgacatgagaggtgcttggaaagtacttttccctataaagcaatgtcttgcccaggtgactaaaattccaccattagctactaattccttttagtcaaacagtgctctccctggatattcttttaaaaagaagattcaggcaggatgcagtggttcatgcctgtaatcccaacattttggaagactgaggaaggaggattgcctgagcccaggagttgccagcctaagcaacatagtgaggccccatctctactaaaaatttaaaaattagccaggcatggtggcacgcacctgtagtcccagctactggggaggctgaggtgggaggattgcttgagcctgggaggttgaggctgcagtgagctataatcatgccactgcactccagcctgggtgacagagcgagaccctgtctcaaaaaaaaggaagattccaaagcgtttattgtaaatgtcttagtctagaggagaggcctaagcaatgcttcagtcctggaaaaacaaagtaataataataacaataacggtagcaataactaacctatactgagcaatcagtatgctcaaggcaccatcccaagtactgaggacacagttgactgcaaaggcttttgagagggtgaagaaaagcatgtgtctattttagataagaagctgctaatatctccccaaaataccactcccaaggctgagatcagacacttggtgtctttccagcagagaagcatcgccacatttgccatctcgaaataagtctggcatcttccatggacaaaacttttggctgccaagtagctggggcacgcctgaggctctggccacctgacgtcctagagggagggccttgcacggagtcctagcagcggagaggggagagcagggggaggcaggggaaagtttacctcgacacttttccctaaaatgctgatcttaggtctagacaacagaaaagatgctgctaaaattactatgaagtctttccccaaaaggcatttggttacatctgattttaacgtgcacttgcagaagtccactctctgggcccatcctgggcttccagatgagggtctggaaagggcccctgagattataaacccaataaaagagacgcagaggcctggggaggactttccaggaaggaaatgcagagcagcaacaggaacacaggtcccatcagaccagggtgcgggtccagagccacacagaacgcctgataccgccttagcctgattgaggacagctggggagagtggtgctgggcaggaggtgctcaggcagagctgagaccctgaaggtaggagaaatggggacagtgcagttagagaacaaagaaaactcagtaagaaacaagaccaccatgtcacttatcccagggtttctgttgtgcacatgcatgctttgtccatgcagtttgagtctatccatcttttgaccctactagatgagtgtgtcgcaaggtgtggttagctccattttatcaatgaagagaatacgaggcccagagaggttaagacaccatttcaggatcacacagctgcagtaccaggcctccaacccgccagttcacaaatgctccatctcttcgctccaacattctgaccttttttgagttcgtcaactgtgccaagccctccccactgctgggcatggtgagctgtattccatcaccaccaaaggcccatccagtgccaggcctgccatggtcacctcgctactcatgtctcagtcacagctcatcagtcctttttctcagaaggcttctgtgcagttgaaatctaattcccctactccttgatgcaccgccccccagaatggatcgcatgatagcatcacacccacacctacctttcctagagcaaagccatataaaaatacctggagggattgctgaaactcagatgcccgggcgcccacagagattctgactcagcagaacctggatagggcccggggatctgcattgctaccaagttcccaggtgaggctgaccccatgctgtccaatacagtcgctactaccctcatgtgagtatttaaataaaaattaaccaaaagtaaatcaaactgggcatggtggtgcatgcatatagtcccagctactcgggaggctgaggcagcaggatcactggagcccaggagttcaagtctatagtgcgctgtgactgcacctgtgtatagacactgcactccagcctgggcaacacagagataccccatgtctaaaaataaataaaaaagaactgggtgcagtggctctcacctgtaatcccagctactctggaggctgatgtgggaggatcccttgaggctaagagttcaagacctacctgggcaaaatagagagatctcatctcttaaaatataaaaataaattagctgagtgtgatggtgaacgcctgtagtcccagctactccagaggctgagatgagaggatcacttgagcccaggagttcaaaactacaatgagctgtaaccatgccagtgtactccagcttgggcaacagggcaagaccctgtctctaaaaaaataataataataaatacatattgttaaaataaatatttttaatttttttaactaaatcaaatttaaaatggcagctctggccgggtgcagtggctcatgcctgtaatcccagctctttgggaggctgaggccggtggattacgaggtcaagagatagagaccatcctggccaaatggtgaaaccccgtctctactaaaaatacaaaaaaattagccgggcgtggtagtgggtgcctgtagtcctagctactcgggaggctgaggcagaatggcgtgaacccgggaggcggagcttgcagtgagcagagatcgtgccactgcactccagcctgggtgacagagtgagattccgtctcaaaaaaaaaaaaaaaaaaaatggcagttcctcagtcccactagccaggtttcaaatgctcaaaacccatatgtggctagtggctaccatattggacagtacagatatagaatatttccatcttcaccaaaaggtctattggacagcactggtctagactctagagcacatgttactgttagtaatcataggctcatccacgagtatctttttttttgagacagaatctcactctgtcacccaggctggagtgcagtgatgtgatctcagctcactgcaacctccgcctcctaggttcaagcgattctccctgcctcagcctcccaagtagctgggattacaggcacccaccactttgcctggctaatttttgtatttttagtagagacagtgtttcaccatgttggccgggctggtctcaaactcctgacctcaggtgatccacccgccttggcctcccaaagtgctagattacaggaatgagcccatccatgagtatctgattacagatggtccctgacttaaagtgtttagacgtgcaatggttcaacctcacaatggtatgaaagcaacacacatttagtagaaactgtacttcagtacagtactcaataaattacatgagatattcttccctttattataaaataggctttgtgttagattagtttgcccaactgtaggctaatgtaggtgttccaagtatgttaagataagctcgctaagccctgatgtttgtaggttaggagtattattaaaggtatatttgttgaataggtggatggatggatggatggatggatggatggatggatggatggatgcatggatggatgggtggatggatgaatggatggacagatggatggacagacggacggacggacagacagatgaatggaaggatggacagtgagctgaatggcaagaactccgaaaggggcagagactcccagtggcctaactcctcttgaaggcagaccccctacctcccttgattgacctgctagagcatgaaccctctgcttaatcccatagcccctgccccaagatatgagcagcagaggaatatccgctaggccttggataaccatgtcctgcttaaccaagaggaagctctgttggaaaagaaagtcaatgctaaaatgcctttactattttcagttcttggatacctagcaaacaagagctgacaatctgactttaatagctccagttctgagtgtcttaaagacatttctttccaactaagtaacccaaataaatttagctacatttttttaataaggagaaataattaaagaacagatggtgttgcttactttgaaatttttgctctaaaatagattttgtgtgcaccttggttggagttcaactctccccctcccccttgcattcgtgtgtcaggaaaggagatcagttcactaattacctggctgtcttttccctacaagatcccaatttaagaatctcgtttcattctaagaaaattaattcaaaatgccaaataatttaaaaatgtattaagattccccttagactagaaagcaaaaaggagctttcatttgtctgttaaaaatcaccttgggtagtagattgaagtttagctcttaagacttgatccccacaattgggcttttggcaaaagctatgggttccatatgtccacaaaatgtttcatttaaaatatatgtgcttttaaattggtctctgaccatttctatgccacagtctctaactgctccacgcattttcccaacccttggagccttgttcgcctcggaagctagactcttttatttgcattggaggtaacctatttccagcatgccaaaacctgttcactttcaaagccacttttggagattttatagcctgaaatggaataaaatttaaatttaataaaatttgagacctgaacaagaaaaaaaagaaaaactgaacgggtttaaaagccagctacccagacgcggaggaaaatattctaagaaaaccccacagggtggtggggcgggggcaggggcggggggcgatggggagccagaccatggatagcctgccaaatgtcatctggggctggctttagaagagaaccagagctggggaggcaatgcaattatttaaatccagaaagaaaaatgtttgctcccaaatttggcagcagatgattgcctctgattcttcccatttccaactgattccatgcaagcttaagtggaggaagcttcaggcccagaagaacgcacaggatgagggtcccacacctgggctcgaggcgtggtctgcaaagtgaaaagtcctgctctgtgaccagatgaacggagggtctcactctaaggccttcaggggtggcaaagcacatttttctttaaaccacaggttgtaacaagaagagatttctctcttcctttgtttctccctgtctctgcctttgtccctgcctggcagccccctcctctgcccctgctgctctctttttccctcccccggtgtgtgcgaaggccgagcctggctgtcactcaggcccttctgtgggcccagggaaggaggccacacggggctccccaggcctcagggtatttattaccacccccgacagcccagaccctctgcagcctccaaggctgtgctcaaaggcggtgaggtctgctgtgcacaaccatgaaagggcctctgggggatgcattcaatgcctccagttgggtcttcctctctctcccggagaaggttcaatcacttccacatccctatcctgctagaggaaagagctgggaaagccgaagatgagtaagaagaaacactccagcagtccctggttggctggtgaattccaacagcacgtgggcaggatctcctgatacaggagactgtgggagtatttgggctgaaatgacaacccgtttgcctaagtcacccccgcaggaattttttttttttttttctgaaatggagtctctctctgttgcccaggctggagtgcagtggcgtgatttcagcttgctgtgacctccgcctcccaggttcaagtgattctcacgcctcagcctcccaagtagctgggattacaggtgcccaccaccacgcctggctaatttttgtgtttttagtagagacagggagtcatcatgttggccaagttggtctcgaactcctgacctcaggcgatccacctgcctcaacctcccaaaatgttgggattacaggcatgagccaccacatccggccccctgcaggaatttttaaatccaagttagatggggtcaagatgatgttgctccttcatcctccccaggcaaggcccctagctgagtcagaagggatgagacccacattgtccaagagaactaagctctagttcgagctccttctgtctgcctacttcccttgccccacccctcagcccaaggcctcccctgctcacccctcttcttatgcatccatgtctttcttcttttacagggtaaaatccatccttctccaggaagttttcctgggggaataaatacaaaatttcttattgcaggctagtaagcatgtgcaatctcctggtgaaataacacttgtatacccatttgacagatgagcaaactgaggctcagactacttaacgacttgcccaggtagtcatctacgcagccaggatttaactgcttttccagatacacaagtgaattttcaaagcctctggatggctgatcccctgtcttgagcaaggtccttccctggggtatggcccagaggtcaggataggaggccctaaggcatcctcaccttctcttcagaccaccctggtgactaatgactctgggcaaagcagagaggcccgagtcggggacaaggcctgtgatcgaccttgaacttaagaagctccaagctctcaccagcgatgctaatgggccaggagtaacctgagccagcccttggatggaaactcaagccattatgcctggctggcctgctggtcggctggcatcactacctggacagaagcctcacttctccatttcacggggcttctgttcagagcaaccttttctcttgcaacaacaaaacagctcccatttatcaatcactgactaagtgccagacactctgctaagcactttacacacattatcttgtttaatcttcacagctgtgcagaaaaaaacgagtgttaatgctgcatcacaggcaaggaaactgaggctcagagaggataaggaagttgctcgagggtgcacagctagctggtaagctcaaagctggtgtctgaacaggcctgtgttcctaaccagagtcctatgctgcccttggaaggagattcttgcttgagattatggataatttgttttaatattttttcaaaatgctctgcaacattccgaaagggaaagaaaaaagttataacttgttgggggaaaaaaaaaggagaagaaggaggcagaggagacagtaagaggaaggttgggtaatctgcgaagttaccgtgatatgtggagggaaaatacacacacacacatacacacttgcacatgtacacacaccaacaggcttcatctgtcatgtatctgggattttgtgttaaaggggccgggcacagtgactgacacctgtaatcccatgggaagacagaggtaggaggatcacttgagctcaggagtccgagaccagcctgggcaatatagtgagacctctctacaaaaaaaaataaaaatttggtacacacctgtagtcccaagctgctcaggaggctgtgggaagatcgcttgagcccagaaagtggagattacagtgagccatataatgccacggcactccagcctcgatgacagagtgataacatctcaaaaaaaatttttttttaatccaaaagggtagtttttctcatctagggtttagattattagtgtcaaaactgggggggaatgtcccaaaataaattattccctatcatgcttctaagctacccaagagacttctaagcccacagccaggcattgcgtctccagccagacactgcacacgcttcctcagagtcctcccagcagtcccaaaggtagagattagagcccccctgtcacaggtagggaccctgagcctcacagagagtaaggtacaggcccatggttcctcaggtgacaagagacagagccaggttttgaacccaggtcagcctgcttccaaagcacttccaccctgcttgcaacttccaatcatgccaataccaagttgggggtgggggaggtgtgctgttgctaagtggtctcaggccaggagagagagctacagagatgctacacagagcctgagtggcaggagagtggcactcaaatcctcagctctggccagatttcaggaaggcaggagcactgggtggggagccaggagacctgggcaccaccagagctccaagataaacttgggcgagtcacttcccatctccaagcctttctaagcctcaaatgccattttcctgcagaacaggagcttttctgggtctcactccagaaggaaacctgaccccttgctttcccttcctggaccccgcctctccaccaaatgccacgctgcccagaaaaggacgagattccagggtgccccgtaagcagaggccctgagaatccaatgggcgggcacctccacccaccagcagctgccctcctctctgatgcaaaagaaactcgtgggctggtttttaagactcgaaataaagtttaaatattacgtggaaattactaaacaaatcaaatcactgttaagtagatgtcacaggcttcctctagacaatacatttaatgaagattattgtcctcctggttatagttttagatttgcattttattatcagagaaccacttatgcattactccaggattttcattaggtaaataaatttttatgtggatttcattatattcccttggctgaaatcctgatcacttaacagcaagaatgctgctccgacatcctgtgtgtcaatcaggatgtaactgtttcctttggttgttgaaaattactttttaaaaaatctggtgttgatggcaaaaggaagagagatagggtcagaactctgggtaggttttgtgtccagttctttcactgaaacatacacacaccctaaaaagaaattttctatttaaaaataacacatgtaattttacatacatgggatatataagctcccattctctctttctctccatacatatatataatatatacttttttttttcctggtgtcactttggcctctcagatgtaaactgacacaatggcaccgggtctaacaggactgaggtgcaggtcagtaccagagaaataaagttgaaagaaacaagcttggaagaagcaggaaggaaggcagtgggggagacattcctggaaaggcagccatcagcaagaaaaaaaaaatcttttctaagaagtctaatatgaagcaattaagctaattggaatctagattgtagtgggtgcctccggaaacttgagaccaggggactctcttgctggaaaaatcacacctcaatatcaatgagcgagggcgtgaatgaacgaagtggtcagaaacagaccataacatccagacctaatccatccagccccctaagacacaggcggttccaggccctttccgagggaccaacaaggtttcagaagaatgtactaataataaaatctcttgcttattgaaaagggctggccaggtgtggtggctcacgcctataatcccattactttcggaggccaagacaggtggatctcttgaccccaggagttcgagaccagcctaggcaacatagtgaaacctccatctgtacaaaaaatacaaaaattagccaggtgtggtggcatgcacctgtagtcccagctcctcaagaggctgaggccagaggactgcttgagcccgggaggtcgaggcttcagtgagcggagattgtaccactgcactccagcctgagtgaaagagcaagaccctgtctcaaaaaataaaaaagaaagggctgtcacatgccagggatgggctttgatgtgcattattacatctgtctctggtcaatccagcccagaggactcaaagagaaccttccaagatgcctttcttaagagcaaatgagagaggcaaagctctcaacatggccagggcacgcagcagcaggggctacccaaaatgcagttaaggggaaggggaacaagtcaggctggattgattcatggcatcttcaaccttaactcctgcccagagccaggactctgatgttgaggtcccagtccctaaccacctgtgtgattggggaaggtcattaccctccctaaccctgttccttgcctgtgataataagaataacagcaccaacctcatagagttgctgtgagaatcgaaagaactgaatagggactgcttatgtctagtgcctgggacgcaggaaggaatcaatacatgttcaccattacagggaatgttttctacacagaactatcagcctgaaagtgagtcactttccgacagttctttccagctgttgatgacttaccaaaactacctggactccaattccaagttctttaaggacgcaacaaaacctccttaatcttcgatcccaaaattagtcacctgtgatactcaagtaggggtttgactaagcatttctctctgacctttgaaaaggccactggggaagaaagcaaagggacatgataaaatgaggatgcctgaaaggagggtccccgctgcaacagtggtcctcttcagggggacattccggagggtttgattttc

SEQ ID NO: 500 - DNA, 31916 bp, Homo sapiens
ctccttgcacatttactattatttgcaggagcttgacaacaccaatatcaagtaaccaaagatggccactatacattgcttaaacactctcaaaagtgtctccccatatgtgtaactacacatcagctatatgatccagatgttcataattctaactagatagaagaaagttggccttggtcaccttctgagtccccacaccataattgtggcatggagcactctacttccccattgtcagatttctgaggcatactgagttgtggcttccagtttaaggctttccccaagtcactgcacttatagggtttctgtttagtatgaattttctggtgtttaataagatttgatctgatggtgaaggcctttccacactcagcacatatatatggtttctctcctgtgtgaattcgatgatgctcatggagttgtgatttcttaatgaaagacttgccacagtcactgcattcatagggtttctctccagtatgaattctcctgtgtctatttaagtgtgacttctggatgaaggatttcccacattcattacaaatatagggtttctctcctgtatgaattctctgatgcataattagtgttgattttcttgcaaaggctttcccacattcactgcactcataatgcctttctccagtatgggattgctgatgtatatggagacctgacttcctagtgaaggctttcccacagtcactacatttataaggtttctctccagtgtgaattttctggtgtgtaaagagatttgatctgtcagtaaaagcctttccacattcagcacacctatagggtttctctcctgtgtgaatctgctgatgtacgtggagctgtgatttcttagtgaaggatttcccacaaatactgcattcatagggtttctctccagtatgaattctctcatgtgtaataaaatgggatttgtggaagaaggccttaccacattcagtgcaaacatatggtttttcccctctatgaattctctggtgcatacttaatgttgacttctgaatgaatgctttcccacattcactgcattcataatgtctctctccagtatgacacttctgatgtatcctgagccgagacttccaggtgaatgattttccacagtcgctgcatttataaggtttctctccagtatgaattttttggtgcttaatgagatttgacctgtcagtaaaggccttaccacacacagtacatatatagggtctttctcctgtatgaattttctggtgtataatgagatttgtcttgtgagtgaagaccttcccacattctgaacatataaagggattctctcctgtgtgaattcgctgatgcacatggagttgtgattttttaataaaggatttcccacagtcactgcattcatagggtttttctccagtatgaattctttcatgtgtgataaaatgtgacttccggataaaggccttcccacattcagtacatacataaggtttttctcctgtatggattttctgatgcatacttagtgttgatttccttgtgaaagcttttccacattcagtacattcaaagtgtttccctccagtatgaatttttttatgtatattaaggtttgaattctgagggaggtttttctcacattcactgtactcataaggtttttctccagaatgaattctctggcatctgaacagatctgacttctggataaaggctcttccatagtcactgcatttatagtaattcccctcataaggagttttctgacggtttgacttgagggaaaaatccttctcatattcagtgcatattcctgcataaaccctctgactgccatcaagctgggacttctgagtgaagactgcctcacattcatggcattcatgctgcttttcttcagcacaaatactctcatgtgcaaaggcatgtgacttcggggagaaaacatttacgtagtcagaaaacaaatagaggctctctctagtatgaattttctgttgttgaatgagagcttgcttatgatgcagaggtttcccacattggttacattcacaagcagtcacttctgtatgagaattcaaatgagtgaaaatatcaccatctccaatagtcttatcagaattttctgttgcattgtttctattatataaggttatgataggctccaaattctttccacacgagttacagttatggggtctttttcttgaggaaaccaggtgtgtgtttacatgaactatttccccaatgtccttatattcaaagatgctgtcattagctagtgttttcttgttaatgaagacaacacgacttaaaggtttgttctggttttctccacattttcttgtgtgttcatcgtctttccacaattcttctaaaatggaatatgggtcatctcttgtgaagagattaatattaatctcagactggaaagaaacttcttcagacatcctctgttgtaaaggtccaaaaccaatgtccccatctaaaaaagaaagaaaagataagactgacaaaaagaacaattaacagaaaataaggccaggtgcggtggctcatgcctgtaatcctagcactttgggaggctgaggtgggcagatcacttgaggccaggagtttgagaccagcctggccagcatagcaaaactctgtctctgctaaaaaacactcaaaatattgtctctactaaaaattagccaggcgtggtggtacatgcctgtaattccagctactcaagtggctgaggcaagagaatggcttgatggcttgaaggcagaggttgcagtgagctgaaattgcgccattgcactctagtctgggtgacagagcaagactctgtctccaaaataaataaataaataaataaataaataaataaataaataaataaaaatacaatagacctttgattcaggccgggtgtggtggctcacgcctgtaagcccagcactttgggaggctgaggcaggcggatcacctgaggtcaggagttgaagaccagcctggccaacatggagaaacctcatctctactaaaaatacaaaattagccggacatggtggtgcatgcctgtaatcctagctactcaggaggctgaggcaggagaatcacttgaacccaggaggcagaggttgcggtgagccgagatcttgccattgcactccagcctgggcaacaagagcgaaactctatctccaaaaaaaaaagagttgattcaaggcagacacagagatatgagagagactatataaatataacaaatgtacataagtattttaaatatacataaatatataggtataataactcatttatatataatatgtaatacaatgatgtagagtaataatattaatactaacatttataacatgataaacaatatcatttagatgtgctgttctaagttctatattaattcacttaaactttatcacggcccggtgtggtggttcatgcctgtaatcccagcactgtgggaggctgagatgagaggattgcttgagcccaggagtttgagaccagcctgggaaacatagtgagacccccatctctacagaaaaatgaaaaaacaattagctgggcctagtggcacatgcctatagtcccagctacttaggaggctgaagcaggaggatcacttgagcccaggtgtttgaagctgcagtgagctctgatcgcaccattacactccagcctgggtgacagagtgagactctgtctctctctctctcttttttttttttcttttttaagacagggtctcactctgttgctcaggctagagtgtaatggcatgatcagagctcactgcaacctccacctcctgagttcaagggattcttgtgcctcagcctcatgagtggctggaactacaggcatatgccaccacaactggctaatttttgtatttttagtagagacggggattcaccatgttggccaggctggtctcaaactcctgacttcaagtatctgtccgcctcggcctcccaaaatgttgggattacaggcgtaagccagcaagcccagccaagaccctgtctcttaaaaacaaaaacaaaaagcactttattgtaaccctttgctgttggtattattattgtttctagtttacagatgaggaaactgagccacagaagagtttagttaaatttgcccaaatcaaatgtttagtaattggggaagaagagattgcaattcagtgcaaatgtagtagaactacatggtgagtgaggtgtcagaagaacaaagtgataaactctgtgaaaagaagtatttctgagtctagattcttttccttaatctgtaaatcctcacaatcttcctgttttctcttctccctatgatccactgtgccctaaataccaatgtatttatgtttacagtaaaattacgatatcttagtcatcctaacttggccaaacagaaaaatttatatacatttgttatatttatatagcctctctcatttatctgtgttttccttgaatcaactctatgtaacaattggtctattttcttttgagatggagcctcactctatcacccaggctggagtggctggagtgcaatggcgcgatctcggctcactgcaacctccgcctcccgggttcaagcaattctcctgccttagccacatgagcaggtgggactacagacatgtgccgccatacatgtatttgtaaaaatacaaatttttgtatttttagtagagatggggtttcaccatgttggccaggctggtctcaaactcctgacctcaagtgatctgcctgcctcagcctcccaaagtgctgggattacaggtgtgagccaccgtgtctggcctatggttcaattcttcatccctggtttggggtactgatgtgataaatgcatctggtagaagacataacaggaaagaactagacatcagaagagaagactgaaagttgttcatcaaacctgtgcccttccttcacaatattaagcttgtagccaagcacatggctgcttcacaacactaggtttgttcagcttcatttgtcactaggtggcactgagtaactctttttcactcatcagtggaagtgataaggccaatgtcttaagaaagtgggtttgtctcctacaaacctcttcttttcccaccagtatattccaacttggcagcacccagttctatgaagctggcaatgccctagggcaggggtcagaaaactgaagcccttgggccaaatccaggcctctatccaaaagctaacaatgtattttacatttttaaatggtcaaaaaattaaaagaagaatactacttcacgacatatgaaaattatatgaaattcaaatttcagtgtccataaagtttttattggaacacagccacacccatacattgatgtattgtctatagctgctttggggctacaactgcagaaataagcagttgtgacagtagccatatggtccacaaagcctatttacttttgtgcctttacaaaaaatttgtcagcccttgccctaggggatggtggtacaatgactttctagaaactttgtccctgaacggccatggaaacagagttgcccggtgttatggccatcgaaaagggactaacacacatctttccattagtcactgcagtctattttatcaatgaacccaaacatacagtcttttcattttctccatttaagcttcctttttctgatcttttgtttctatcaaaaattcattgttcttcattaatcatttggggttctctgctttaaaagctaatttcaaatttcaccacaactctagagaggctctcttttaacttaaaaacaaacaacaaaaaggtactctgaaccactcatatttatatttgaattggcatagatgtgcacgttaacaaaagtgtaatgcacaaagactgaaattttcaagatttcatgcagttatcctctttccaattagtttttctagccctttgaattgctcctaaaagaaaaattttaaaatctttctgaaatagagcaaaacgacctcctctgcttataacacaaattcaggaatttaatttcactattttctacagaaactttgcattttaatgtacaagagtaaaagcctcagttatcatgtaatttaatgtaggtttctctgaatttctggaggttgtatgctgcaataggtcaaattcaaggagtaagtgaaagctgagcacaaaatatgtgtattatttggttttttgtttgtttttgtttttgtttttgttttctgagatagagtctcactttgttgcccaggctggagtgcagtggcacgatctcggctcactgcaagctccgcctcctgggttcacaccattctcctgcctcagcctcccaagtagctgggactacaggcgcctgccactatgcctggctaattgaccttgtgatccacctgcctcagcctaaagtgctgggattacaggcgtgagccaccacgcccagccttttttttttttttttttttttttgagacggagtgtcgttcttgtcacccaggctggagtacagtggcgcggtctcagctcactgcaacctccacctcctgggatcaagtgattctcctgcctcagcctcctgagtagctgggattacaggcccctgccacctcgcctggctaattttcatacttttagtagagatggggtttcgccatgttggccaggctagtctcaaactcctgacctcaggtaatccacccacctcagcctcccaaagtggtgggattacaggcgtgagccactgtgcccagccaaaatatgtgtattatttgaatacgcagatagataacataataatcaaagggctcgatgaaaagggagaattaaagaaaatcttaaaataggatagaaatggttatagaaaacagggacaaatgtgaattgcaaatatgaggccatattctttctctagcttacaaacctactgagaggagaatctgtcacatgttagatattaagtagtaactttagttttcttccatgtagctatgacaggataaacacagcacacaatgttttaagtagtgaaatctatcagcagcatctgagatgaaatagtgaaaaagaaagaatgggattatcacatacaaataggattagaataatctaggcatgagaaaacacagacatggttgtaggtgatatgactgggaggtaagaaagaggcttttgtaaatgagaaaaataagtagaaaagcagaatgaattatctgagaagatggattagagggaaaagtaaaaaaactccaagagaagatgacaacattttgaaaggcaagccacctgcttttacatgctacattgtatcttgtcttccttcacacaaacagccagacccttaaatgcaaacagtattggtctttcccctgagtgctgtatacaatagggccaatgcctgactgagacacacaaataacagtcacagagtaaaagttgttcccatgagccaattatcactcagagcttatgctgcagctgagacacataatctaagacacagattatgctgggctgagacacatggacctgggcaactttaaggagggcccaaagcccttacacctgcctctaaatgtccatgataacttctaatgtaggttagttatgtataggacagaggcaaagtgcatacttgccagcaggcagtataaccagttgggaagaggagaaagacccctgtgggggtggtcattgccttgacatcctgcttattgccccagctgtaaatgacctgcaaggagaaatggaccccaccccaaacttggttcagatgtcaagagtgacgatgagacacacacaataagagggtgtaaaaagatttgttactcacataatgaggctttctggggacagctccaagcaggtccagatggggctagagtgagcaaggaaaggactgtcttgggagtttatggcaggggcgggtggggctgggctaactattcccttatgtagttggaatttcccagcaacaatggagggaactcatgggcttttttctcagtttgtccaggaaaaaaagagagagagatgaggcttagaaaacatcagcagttgaacatcaaaaatgaaggatacagaatgagatgttcaaagtattttattagggaaatacaaattaaataataattagaaattaaaacccatcagattagccaaaatattaaaaatttggataatactaggtatgggtagggatgtggggaactaatacccttgtacaaagttccagggaccgtagagtgacacagccaatctggaaaataatgtgcttatacctcatcatattcaatattagtatgcccaatgataaagcaatcccactcctcttccttaagaaattctcatttccggctgggcgtggtggctcccgcctataatctcagcactttgggagtccaaggcgggtggatcacgaggtcaggagatcgagaccatcctggctaacatggtgaaaccccgtctctactaaacatacaaaaaattagctgggtgcagtggcgggcgcctgtagtcccagctaccggggaggctgaggcaggagaatggcgtgaacctgggaggtggagcttgcagtgagctgagatcatgccactgcactccagcctgggggacagagcgaaactccatctcagaaaaaaataaataaataaattatcatttccagtaagaataattcatgaagaaatgtattgcagtactgtttgtagtagctgaaaaactggacaagtaaaatggggtatatatgtgcactacagaatgatatgtagaaattagaataatgcactgcaacatggaccaatttgagaaaaaaaaacttgagtaggatatataatacagtaccatttctacaaattaacaatgccaacaactcagattttataaatatcccagaaattcaaggataaatggcataacatgtcaaatatattagaacagttgcctcttggaaggataaaaatgagtatggagactgaggattaaaaagaataaataagaggggagccttaaacacattgatgatgatattgactaaaaactaaggctataattattaactcaatcttctgtacaggatatacctgtacactagataaaaaactttgtgtaagatatgaaaataaataaattagaaagatcaagtcagtgttgcgttgcactagccaagtaggaagaaaatgtcaatggtactctcaaagtcaacaatcagagaagaggcatggggggacttcagacaagcccatctctagatgacaattgtgaggcactaaggggaaagagacaaaatgagaagaaacagcaggagctgaagttgtaatgcatagtaatgttttcagaaggtagatctatgagtatttgaatgcataaggaaatgatctaagaccttgatggaggtagaaagaataaaacttttctagggaaagagagaaaaaagcaagaaaacaggaccctagaaagtagagtgtgacatgatccaaagaaccagtaattgtagcatattccctcctaaaaagccaagcaaagaagaaggcattgatatgagaagggatcttaagtggggttagcatttagctatccaagggtccttgtctaataactgctcttccaagcagttctaaaagtcattattaatgacacatcaaagttgggcaaagttgggcacagcttctcccagtacaaatgcagctgagtcatactgtctaccatgctcttggttcccttctcacctggacggctctgactggggatctcaccatccaacatacatggctcttcttgttccaagctgaagatgacttctggtttgggaacttgacatcctgttaacaggggatgatagaggacttgatttcagaggccatacaatgaagcattccatttttttcccaaaaaagttcactgggaacagaggaatattcacactacccgaaagagattattaagaacatgggacaaaataaggacaaaaccattacacactttagatgtcctgcagtctttagaagtcccacatacctcagaaaacacagacttcagcaattctactgagaagaaaaatatactcaattaggtgcagcctactctatacccagcagagccgtgcttacccactgagatcaagttgaaatagttttccagcatcacttctctgtacaggcttttctgagcaaggtctaattgttgccactcatccctactgaagtctacagttacgtccttgaatgacactgattcctgttaaaaaaaaaaaacaaactttaaaataattttttaaagaatatatttgaattcaaaaaaaaaaacctttcaatgtgaaggatcgagattacagaatggaaacaagataggaccttatttttaatgtgatacaatatactataaagaacttctacaattcaacgacaacgaacaaaataattttaaaaatgggtaaaaagcttaaatagacatttctgcaaggaagatatacaaatatttaacaagcacatgtaaagatgctcaacgtcattaatcactagggaaatgcaaattaaaactacaagatattacctcacacccatctggatgataaagaaaatgtctaaaattgattataatgatggctgtacaactgagtgaatacactaaaaatcaatacatggtacactttttttttgagacagagtctcgctcagtcgcccaggctggagtgcagtggctcgatctccactcaccgcaagctctgcctcctgggttcacgccattctcctgcctcagcctcctgagtagctgggactacaggcgcccgccaccacgcccagctaatttttaaaaatttttttagtagagacggggtttcaccgtgttagccaggatggtctcgatctcctgacctcgtgatccgcccgcctcagcctcccaaagtgctgggattacaggcatgagccacgacacccagcctaatatggtacactttaaatggtaaactgtgtggtgtatgaaggagagggctctttttcagcactgccatttccagatgagatgcagtagcttggcagtccagtgcttccttcaacaatgaactgtaaatgccagacgcaatacttgaaatcatctgtttcaaagcactggaaagctgctgaggtagcaagaaatataggggctaagactggagaggagagaatattaaagattgaagctgacttattcagtcactctgacagtgggagcatttaccaattctggctgtggacaaaagctgagaatccagcttttgtcctggattctcattttgtcctgtctactggagaatgcagtagaaggctgcagctgggtgacagagaaaccaacataactcaaacacatggccattttcccctcaggatatttgctgaattctagggtatatagggcagtagactaaaaatgtaagcaaacagcctttgaagaacagagcaaaagtctagtatctgttaagaaaatagttgggcatctatcaggaagagggtctttagaggacaaaagggctctcagctgaaaattctcaggagccagggtgatccagaggtaaagtgagtcttagcagagcttcaacccggccttatttcaacatcaacagtgcctgactggatgtacgtgttctcccttccctccatttgctaacataaggaaagatgaatcctctgtggagaaagattttttttttcttttcttctgagacagggtcttgctctgtcatccaggctggagtgcagtggcacaaacacgactcactgcagcctcgacctgggctcaagcaatcctcctgtctcagccccacaagtagctgggactacaggcacatgctaccatgcccagctaatttgtctatcttttgtagagatgggttttgccatgttgcccaggctggtctgggactcctgagctcaagtgatctgtccccctcagcctcccaggtatgagccctgcctacaacttattatacacagtgtttaaaacaaacaaaaaaatcctacacatccaaaaagataggaccacatatccaaaatcagagaaggaaaaaattcaatagaaacagtcacacagagaattggagttagatgaaaagaggactatctttagagagttggttcttataataaagaatcaaatgaaagttcaaaaattgaaaaatctaaaatctaaaattaagaagtccttatgcaggtttaacagcaaaatacagaatttctgaaatggaagacaagtaaatagaaaatatccaaactgaagcagagattttttttttaaagaaaaaaacataggagcattaggaatatgtgtgacatagtaaaaaaggtataacctatcagagtctgagaagttaaagaggagagtgcagggaaaaagcaatatttgaagaagtaatggctatgaatgtcatcaacccttaggattcaagaagctcttcaaatacctctttacaaaactgcaagtattgactatgcaaaacagtaacagtactattctgggaggtttaaaatgtatgcaaaatttaaaataatggaaataataatgcaaaaatgggaggcagtaaatagaattaaagtgttttataaagtatcctagcattattaaggagataaaatagtaagttcaagatgaatgttttaatatctggggtaacaaacagtaaaagaattataacaagtaaacaaaggaaaaaattaaagagtaaaaaaattatgtaatataaaaagtcaagaaaggaatgaaaaaataggtagttcaaataaaaactaggccgggcgtggtggctcacacctgtaatcccagcactttgggaggctgaggcaggcggatcatgaggtcaggagatcgagaccatcctggctaacacggtgaaacccggtctctactaaaaatataaaaaaattagctgggtgtggtggtgggcacctgtagtcccagctactcaggaggctgaggcaggagaatggtgtgaacccaggaggtggaggttgcagtgagccaagactgcaccactgcacaccagcctgggcaacagagcaagactccatctcaaaaataaaataaaataaaataaaaactaatagtaaggtggtatatataaattcaagtatatcagtaattacattaagtgtaaatgcattaaacatccaagttaaaagcaaggattgagacttctggttctaaaaaacaaaacaaaaaaaagagtgcattccacccaattcctcctgctaattacctaaaaatctagaaaaatacataaagcatctgtcagaagactcactggtggagaaaagaaagtagaacctaaggacttaaaaaacaacacagtagtgagttagttccctagagggaacttagagggagagagggagctcctacatattgcaaaatgagtactagaggagcttgcaacctggaagaaccaatgagcacagacaaaaaaggcctccccaaagcatacattttccagccaaataatttgaaatagggcagcaatgcaggatgggaccttttgactacacatacctacaaagttcagaagtacccaagaacaccctcacttctgacacctactgcaagcagagggatttcccaggatcacctgtacttctgacaccaattccaagtcaggggtccccaggaccaccctcaggttccacaattcacagaagaactcacagaaattagaaaagccataatactcatggctatggtgttatatagtggctttacaatgaaaggatacagatcaaaatcagccaagggaagatgtgcttagtgcagtgtcaatgagagttccaggtgtgagcttccagtggttttctcccagtggagtcatatggacagcacttacttctcccagcaatgatgtgtgatgataatacgcatggagtattgccaactggggaagttcacttgagccttgatgtccagagtttttactgagacttgatcatgtggacatgaatgactcccactgtggctgatcttagtctccagcccctccagagctgatattgcatggccaaaggtaccccactataaaccacatgttggcatagaatattcagtgtggcccaaagctcccaccataaatcacactgtcattatatactatcttgcatggcctaagcaaggcctgcaggacattccaaagatttagaggttacctcccaggagctgagtgcaaaggccaaacctctctttgggcaaagttaatcctttactgcacaacaatatacttgaggccaggcgcggtggctcacgcctgtaatcccagcactttgggaggccgaggcaggtggatcacgaggtcaggagatcgagaccatcctggctaacatggtgaaaccccatctctactaaaaaaatacaaaaaattagccgggcatggtggcgggcgcctgtagtcccagctacttgagaggctgaggcaggagaatggcgtgaacccgggaggcggagcttgcagtgagctgagatcacaccagtgcactccagcctgggcgacagagcgagactccatctcaaaaaaaaaaaaaaaacaacaaaacaaaacaaacaaaaaaaaaccagtatacttgaggtgaaaactacaaaagatgcatcctttgccttcttcacaaacaatgtgactccaaagatggtggggtggagctctctcaatcatcccaactgcattagctcaaagagaggtagcacccctcttgcctctccagcaggcattatatagactgtattggctaaccctaccccaaattaagtgaatgacagcaaagaagaagtagctaccttcttccaatagagagtggaggatggattatggagaaagttataaaaaggggttctttaaatacatgtatgatgacctgggcacacctacgagcagcccagatataaaatgaatcagaatcaacatagaaaaagctttcagggctgaactagggtgtgggatactgtccaggtttcaaattagcttctgggtagcacaaaaatgagggagaccaaaatagaactgcaaagactttcaaaactaagttgaatttgaaatacagcccataaaaatagaccaagacatgcactctaaacctaaatgtgttgacaactgctaaaatagaggatttgaagagaaaacagaatctcataacatgatattcagaatgtcctgaataaagccaaaattattcatcatcttaagaaccaagaaaatctgaaatcaaatgagaaaagagcatcaacagatagcaacactcagatgaatcagatgttggaattatttgacaaggatttaaagtagctaactaaaagtgttgcaacaagcagctgtaaatagtgttgaatcaagtggaaatatataaattctcagcaaagaaatagaaggtatgaggaggaacaaaatgaaaattttagaaccaaaaaatacagtaagtgaaattaaaaacctcactggatgatctcaacagcagaatggagatccaaaggaaagaatcagttacctcagttacctgtaagatagataaacagaaattatccagtctgaacaatagaaaaaataattgatgaaatgattgtttcatcaattccctcaggctgtattcagcctaagggacccagcgggacaataacagaacagccaacaatcatttcagcagtcctagaaggaatgaaaaagtaggacgggagactggaaaaagatatgaagaaataatagctgaaaacctcccaaatctggtaaaaggcataaatgtacagattcaagtcgctgaccaaatctccaaaaggaaaacctcaaataaatccatgtctagatacattgtaagatttataaaatccaaatttaagaatagaacctgaaaacagtcagagagaaatgacacattacatgtagggaaagggcaatttgaacaagaatgactttctcattaaaaaccacagatgtcaaaaggaagtgggaccatatttttcaagtgctgaagagaaagagctgtcaatattgaattcaatatccagtgaaaataaaataggctctgtttaaattctcttaaacttaattctgaggaattacctgccattggtagttgagaaagaagtctgaaaaaaaaaataaaaaaagaattaactgccatacatttattaagcataattacttaggtaattcttaggaattacctgccatatatttactaagcaagatgttgagaactttatgttgtgaacatcttcacaactttacacaatatgcttcaagacatcaaagaacttacaacaactttctaagatattataaagggcataagagatgtgcaaagcatagcatgaccccaaatagagagaagaaaattctacatggagtgtaagactaagttctgtagagttgatgaaacttaagcttagtcttgggagatgccatgtttaatgcaagcagagtagggcaaagtgatttttagaagggagcagcatgagcaaaggtataaagacaggaaaatacatgataaattcagggaaccacaaattagtctgcataatgagaagtctgtatgcagtgaaggaaaggtgtttatgaggaaatttcagtagaggtatgctggcatgagatcatgcaactatttttcctccaatacataatggactgccattaaagtaatttatatatagagaaaagattattagatttatgtttacaactgccaagaagatgctggccaggttgtggagaaataggaacgcttttacactgttagtgggaatgtaaatttgttcaaccattgtggaagacagtgtggtgattcctcaaagatttagaagtggaaataccatttgacccagcaatcccattactggttatatacccaaaggaatataaatcattctgttataaagatacacgcatgcatatgttcattgtggcactattcacaatagcaaagacatggaatcaacccaaatgcccatcagtgatagactggctaaagaaaatgtggcacatatacatcatggaatactatgcagccataaaaaggaatgagatcatatcctttgcagggacatgcagggagctggaagccattatcctcagcaaactaatgcaggaacagaaaaccaaacgctacatgttcttacttataagtgggagctgaacaatgtgaacacatggacacagggaagggaacaacactcactggggcctgttggggaagggtggggggtgggagagcattagggaaaaaagctaatgcatgctgggcttaatacctaggtgatggcttgataggtgcagcaaaccatcatgacacacatttacctatgcaacaaacctgcacatcctgcacatgtaccctagaacttaaaataaaaaataaaaaaagactatcaagaaacagcagggagaatacatttgaatgagcaagagtggaagtctaggcaatatttcatgtgaaagaattaaaacaccttagttagggagaaaatattatttaacaggaatatagaaaaagaaattggtgtagatagtaggtaattagaattgatagatggagtaagaaaaaggaggaactaaagtgaaattctcaattattcgttttgtatactctgagattatagtgtcatatactgaagtagagattgatgaatggaaaaggttggagaaagggaaccagatgaaatcacttatgttttgcacatattgagattacagggattaaacatgtaggcaggcatattataggacgttaggcagaggcctagagtggagataaagatttgggagtcaccagtagataattaataactaaaatcatctgagtaaatgagactgcttgagaggacacctgataaaggagaatgtaaaggaaagaatctgaaaaagttaccagcattgaagaagaggtgtcagcaataaaaactgagaaatcggacagagccaggagagagtaacgtcttagaatgtatgtggggattagttgatggggttgaatgccaagatggatgaaaaaagcaaaagacagataaattctggcttttgtatttaggagatgtgacagtgatagctagttgtcttccaacattcactcatcctttcttccctaataacagaacatgaattcttagctggctactctgagtaagactttcttttcccagcccaccttaaatgtaaccaggaaactatactttggccacagagatacaggcgatacttctgagatgtcagtttttaaaggagaaggtgtgagtgcccctttcctccccaacctcaccatgctgctggcctggaacgctgactcagttaatgcaaccccagcaaatctcgggaactatcaagtgacgtgaggttgaaaatcacaaaatgagaatgacatagagaacaacaacaaaaaaaaaaggtgtataaatttgtgaagacatcaggccctgaatgaatactttcagacttcttttgcttcttttgtgtttaagcccgtaattcttagatttctgttatactaaaatgcattttgccagacaattctaataaaatagatagaaactgggttgcaattacagactcttaagcttttaagcaaaaaattcagtaccacgtaatagcaaaaagatcagtacttcaggaaaatataattcatattttgaatgacaatctaaaatacataaaacaaaagttgacaaaattacatggagaaattgataaacctacacacgcatgggagacttcccaactccccctccctactctgagagattttaaccagattacattcattaatcactagatatagcaacaaaaatttggcacatataggaaaatttctgcaagaaaattgacaagccagttacaaaggagatgagatctcacacataaaacaaatatgcaatagtcaaaaaataaggattatacagaagatctgaacaacacaaataagctgtttgtgatgtagacagaaatcacacacacacacacagagagagagagaaagagagagagagagaacgagagagaaagagtatattcatcattatattaggggaccatacatgaatgacagtgtgatagtacacaaaatgtaaaaagaacataaatgtaacaacaggctgggtgcagtggcacatgcctgtaatcccagtactttgggaggccaaggcaggaggattgcttgagtccacgagtttgagaccagcctgggcaacatagtgagaacttgtctctataaaaaatcaaaacaaaaacaacaacaacaaaaagcaatacaaactacagacaactcagtttaaaaaaaagggggaggaatgaatcaagcaattctcaaaagaagtgtacatgacaatgaaattctgaaaaactgttcaatcacattagtaaccagggaaatgctaattaaatccaaaatgagatacctctgcaaactcccaagatggctaaaattgtaaagattgaaaacaccaagtactggtaaagatacaaagtagtaaacatatctgcacactactggtaggaatacaaattggcgtaacaaactttgcaaagctgtatgacatcatatactaaagttggagaggggccaggtgcagtggctcaggcctgtaatcctagcactttaggaggccgaggcaggaggattgcttgagagcaggagttcaagactagcctgcgcaacatagcaagacgccgtctctacaaaaagaaaaaaaaaattagccaggcatggtggcatgcgtctatagtcccagctacttgggaggcaggggaagcaggatcacttgagccctgaaagttgaggctgtagtgagctgggatcacagcattgcactccactcagcttgggtgacagagcaagaccttgcctttggatagaaataacttctgaaagaaatgttcacaagagcatatttcgtaatgcattttatatttctccatagtaaaggcttaaaaataaatgaaaataaaatcataatggtacagaaatgcatatggtataccatcttctgtggaaagaacataatacttttcctatttgtttttgtctatataatgacactttgaacacacactaaaaaaaattagttatccagattgaggacatgggctgataggaaaagaaagagggagatttttcactatgtacttattttcttacttttaaatcatatgcatgtattacctattcaaaatactcatctgacaaaggtctaatatccagattctacagggaacttaaaaacacatttacaagaaaaaaacaaccccatcaaaaagtgggtgaaggatatgaacagacacttctcaaaagaagacatttatgtggccaacaatcatacgaaaaaaagctcaacatcactgatcattagagaaatacaaatcaaaaccacaatgagataccatctcatgccagtcagaatggctattattaaaaagtcaagaaacaatagatgctggcgaggctgtggagaaataggaacacctttacactgttggtgggaatgtaaattagttcaaccattgtggaagacagtgtggcaattcctcaaggatctagaaccagaaataccagttgacccagccatcccattactgggtatatacccaaaggaatataaatcattctactataaagacacatgcacacgtatgtttactgcagcactatttacaatagcaaagacacagaaccaacccaaatgcccagcaatgatagactagataaagaaaatgtggtacatgtacaacatggaatagtatgcagccataaaaaggaatcagatcacatcctttgcagggacatggatgaagctggaaaccatcattctcagcaaactaacacaggaacagaaatccgaacactgcatgttctcactcataagtgggagttgaacaatgagaacacacagacacagggcagggaacaagccacaccagggcctatcaaggggtggggggataaggggagagagagcattaggacaaatagcaaatgcatgcaggcttaaaacctagatgatgggggccgggcatggtggctcacacctgtaatcccagcactttgggaggccaaggtgggtggatcacctgaggtcgggagttcgagaccagcctgactggagaaaccctgtctctactagaaatacaaaattagccgggcacagtggctcaagcctgtaatctcatcactttgggaggctgaggcgggtggatcacgaggtcaggagatcgagaacctcctggctaacacagtgaaaccccgtctctactaaaaaaatttaaagaaaattagccaggcctggtggcaggcgcctgtagtcccagctacttgggaggctgaggcagaagaatcccttgaacccgggaggcggaggttgtggtgagctgagattgcgccattgcactccagcctgggcaacaagagcgaaactccatctcaaaaaacaaagcaaaacaaaacaacaacaacaaaaaaacaaacctagatgacaggttgatagatgcagcaaaccaccatggcacgcatatacctatgtaacaaacctgcacattctgcacatgtatcctggaacttaaagtaaaattttaaaaaaagaaaatattgcacccatgaatattagaaagatcattcagaagtgaagaaaagagtccttaaaattaaaaatacaatattaatgagaaactcagtaacctgaaactttccatgatactgcactgagcacatcttctctggctgattttaatccacgtcctctttctgtaatgaactataagcatgagtataatggctttcctgagttgtgtaagtccttctcgtgaattattgaaactgagggtggtcttggagactcctgagcttgcagtttctgtcataagtgagggtagtcttagagacgcctaaataattttacttgggcttgtatctgagtgtcaatagggctgtattccttctggaggttctaaaggaatatcaatttccttgatttttctagcttctagaggccacctgtattctttggccttaaaacaacacaaacttgtcactattctggaggtcatatgtccaaaataggtcctgctgggctgcactccttctggagactctacaggacaatccatttctatgtcttacccagcttcttgagactcaagagatctaacatttgagaaacatgaggacaattcctagtatcatgtggaagggacagcccatgccagtagctgagtatcggatagagagtaactatgagcaggtcgacaactccaagaggagtttctttaaagagctgaaatgaatagcatgtaatctagagccaacggcctgggtcttattttcctggcttcatcattcaggagctgtatgatcttgggcaaattccttctctgtgtaacagttttcctcctctgtaaaatgagaataatgattatagatagctgtctttgtttactgttactataaaagaacacctgagcctgggtaatttataaagaaaagacatttatttggcccatggttctgcaggctgtacaagaagcatggcatcagcatctgcatctggggagggccttcaagctgcttccattcatggcagaaggggaagagaagccggtgtgtgcagagatcatatggcaaaagaggaagaaagagagagcgaatgggaggtagcaagctcttctcaacaaccaactctcacggaactcataagattgagaactcaccacctccccagagagggcattaatctattcatgagggatctgtccccatgacccaaacacttcccattatgccctaccacctcctacactgggatcaaacttctcttttatttttaaaatttctttttatttatttatttttgtaagaaacagggtctcgccatattacctaggctgatctcaaattcctggcctcaagtgatcctcctaccttggcttcctgaatagctgggattacacacaagccaccgcgcctgggttgggggatcaaatttcagcatgagatttggagaggataaatatccaaaccatagcaataactcgtaggggttgtgactgaattagttaatagagaatgcttatagtgcctggtatatagtaagcactatattaatgtttatattatattactgttattatttagtatattttaatatattgagaaggtatttatatacctgggaagactagcgatgaattactgatatgtataatatatattgtacatgtatgtatggaaaacaaaacaaatgattaagccagacacttataatttcaggtaaaacaaaaagcactgcataaaaagtaaatggctcacttgtgaatattgttaaaataatcatcataataaaatgcagcctattgatttaccccaaattatgatatacccatattaggctgggcgcagtggctcacgcctataattccagcactttgggaggctaaggtgggcagatcgcttgagcccaggagttcaaagatcagcctgggcaacatggtgaaaccccatctctactaaataaataaataaataaacaaaatacccatattagatggagggtacatgagaaatgtgtacgtgagtgtcaagggcctgagtgtctgaaagagagctaattccttctttccattgtgttgtctgtagataactgcttaaaactgaaagcctagaaataccaatacaaacatgttatttagacatatgaaagtaaacagcaaaagataactaaactgagttcaaagtgattacctttgagaagctgaaatttgaagaggaatagagcagatgacaactgttttattctaagaaaccacaaagaacaatttgactaagtaaatataggtaaaactttcatgacattcaaaatgaaatacttatttttaaaagttcaaatgcaaaggacaaagaggcagttataactgaccaaaacgtataagactatgcttaatatatgaagtcctctgttcaaactcaataaactggattccactcctggaaagatacagtagatgcacttgtctctattcatcctgttaagttcatctacaaaccatagacattatccatcaaaccaacatacagactctgaaaggtaaagaaaaataggcaccctggctaggggcctcaggaaccagggaagtaaacagtaataagctctctgtgtctttcggcctcatatagatagctctgaccaggtgttcgaaaaacctacaatccagaaacatcaacaagtgcatacaaaaaggcctggaaaaaagtgttttctctagctaaaagaccaggaaaggggcaacagagaaaaataaaaaacttttagacaaaacctactccaaccaaataccacagattataaaacaacaaaaaactgtgggcttgattcatctctcatcagcaaagactcagtgggtagcctagactcctgtatttgcctggctgcctggggatgcccctccactgcaatagggtagtatgagaaaagccaactggggagctgggactttcatctctgcacagtggtaatgggtagctttcttgccatgccagtgggagccacctcagggctggacttccattcctacctagcagtaatgcgacactcttcccatcacgacaggtgtggtgtgagaggatgtcaaatgaaaacccaagaccttcatcactctgagaggtaatgaggccctatccaacctaacaatatcagagaagacagcatgaagagcagaaacaaggtaccctctcctttcagacaaggtgatgtcaccagaggtctactggggagcctgaactgccaaccccaactagcagtaatgaggtgtctctctccccacagactgtcaacagagttcaagtagggaacctgcaaattcacatccacctggcagtagtacagcaaggccccccaattcccacactggcccagaggacgcctgctaaaaaagaggactcaaataagatctagagtctcataatgcccaaggtttccacaatacattacaaaatcatttgtaaaaccaagaaccaggaaaatctcaacttgaataaggaaacaaccaatcaaccgatactaaaactgaagtgatgtatgttatcagaattatttcataaggattttaaagtagtcctcataaaaatgttttaacaagcatatgaacacacttgaaacaaaaaaacttcaacaaagaaatagagaagagatgaaaaaaccaaatgaaaattttagaattaaaaaataaccaatattaaaaactcaatagatgggctcaaaagaatggaggcaacagaagaaatattctgagtacctgaaaataaagtagaaatgatctaatctaaagaatggagagaaaacagactgagaaaaaaaggaacagaacctcagagacatgtgggacaataacaaaaaatctaacatttgtgtcattggagttccagaaagagaaaaagaagagaaagggatgggggctgaacaagtatttgaagaaataatgaatgaaaatttctgaaacttcccgaaagatatacacttacagatagaagctgggcaaatctcaaaaaggataaaaccaaagaaattcacactaaggaagaattatagtgaaacttgtgaaaaatacagacaaagaaagaatgctgaaagcattcagagagaaactacacattacccacaggagaaaaacaatttgaatgacaatgtgagatactaagaaccatggctccccaaagatgttcacatcctaattcccagaaattgtgaatatgttaggttgcatggcaaaagggaattcaggtttcagatcaaatctaggtggctaaatcggctgtccttaaaataggaagattaattatcttagattatctgggtgggctgaatataatcacaaatttgcttaaaagttaaagcaggagggccaggcgcggtggctcatgcctgtaatcccaatactttgggagggccaatgcgggcggatcgcctgaggttgggagtttgagaccagcctgaccaacatggagaaaccccgtctctactaaaacatacaaaattagcagggcgtggtggcacatgcctgtaataccagctactcggaaaggtgaggcaggagaatcgctggaacccggaaggcggaggttgcagtgagccaagatcgcgccattgcactacagcctgggcaacaagagcaaatctctgcctcaaaaaaaaaaaaaaaaaaaaaaaaaagttaaagcagaggcaataaaagagagtcagagaaagatgcgactacaaaagagtggtcagagagatacaatgttgatggctttgaagttggaggaaagggccacaaactgaaatgtgagcacccactagaagctagaaaagtcagaaaatagaaacagattctttcaggttgcggtgagccgagatcgcgccattgcactccagcctgggcaacaagagcaaatctctgcctcaaaaaaaaaaaaaaaaaaaaaagttaaaggagaggcaataaaagagagtcagagaaagatgagactacaaaagagtggtcagagagatacaatgttgatggctttgaagttggaggaaagggctacaaattgtgaaatgtgggcacccactagaagctagaaaagtcatagaaaatagaaacagattctttcttacagcctgtagaaaggaatactgccctcttgacaccttggttttagttcagtgagacccatgttggccttctaaaatatagaactgtaaaaaaaaaaaagttatttttaagcaactaaatttttgaatttatttcagcagcaatagaaaattaacatgcagttttaactaatatctcatcagaaactttggaggccagaaggaagtagcacatttttcaagtgctaaaaaaaaaaacaaaagaactatcaacttagaattttggatcaggcaaaaatatccttcaggagaatgtggaaatcaagacattctcagtcctccaaaaattcgtatgtttaggctgtaacccctaatgtaactgtatttggagatagggcttttaagaggtaattacggttaaacaaggtaggggtcctaatctgataagacaggtggccttacagagagagattctctctccataggcaggcaggcaggcaggcaggcggtcactagggaatggcctgtgagcacatagtgagaatctggttttcgtctacaagccaagaagagaaccctcatcagaacctgaccatacttgcaccctgatctctcagttccagcctcccagaactgtgagaaaataaatttttgttgtttattccacccagtctatggtactttgttatggcagcctgagctgactaagacaactactaacagctctgcacacataaatttgacaacttagatgaaagggaccagttcctgaaaaacacacaaactaccacaaccctctcaatattaaatagacaatgtgaatagccctgtaacacttaaagaaactgagtttgtaatcttaaaacttccaaaaaagaaatctctaggcccagacagtttctctggagaattctaccaaatatttgaagaattaacataattaacataaattctacacagttttttccagaaaacagaagagaagggcatacttcccagtttattgtgtgaggctatgatttccctgacacaaaaactggacaaagtatagaaaaagaaaacacaaactatacacaatctctggcagaataatcaatacaaaggaacacattccaacttattttatgaggtcagggttatcgtgatacctaaaccagaaatagtaccaaaagaaaaaacagaaagagagacagaaagaaaaaaaaaagcgatatccttcataaatatgatacaaaaacccttaacaaaatattagcaaatacaaataatttaaaaagtatataccacaaccaagtggagtttattccatggatgcaacgctggttcaatattaaaaaatcaatcaatgtaatctaccataccaacagactcaagaagtaaaatcacatgatcatgtcaattggtacagaaatagcatttaacaaaattcaactcccattcacgataaaacctcaaggttgtttcagaaggtggtccttggacaaggagcattgatgttctgtggaaatttgtgagaaataaaaattctcatatcccatcccatagctactaaatcagaatctgaattcaaatgcaagtaaagtgtcagaagcactgttctataagacagcaacagaaaaactgttagtgcacgttctttctttctttcttttttttttttttttttgagacagagtttcgctcttgttgcccaggctggagtgcaaaggcgcaatctcggcttactgcaacctctgcctcctgggttaaagcaattctcctgcctcagcctcctgggtagctgggattacaggcgcccgccaccacacctggctaatttttgtatttttagtgcagacggggtttcaccttgttggccaggttggtctggaactcctgatctcatgtgatccacctgcctcgacctcccaaagtgctgggactacaggtgtgagccaccgcgcctggcctgttagtgcactttcagtagggttgttgttgaagactgctctgtcattaaccatctgaagatctatcaaaaaattcctcaaacatcaagaaccatgacatctttactacagatgaaataaattacttgttaattttattaatataaaccatgtatccaatttccattattgctatgtctttcaggaagatcagagacaatttaacagttcaaagttcatgactgtgtaagaccatatattctaaacttgacttggggctgacagtctcttcttcattttatctgatcttagtttttatttatttagtcttgtcatcttactatagggattgttagatgtctcctaaaatccactaaaagtaaaagaaagcaacaaataaacagatgaacaaataagaactcaccagggacttggtcatttttggctcttcggacaaaggggcagaaatctgagaaaacagatgggtagaggtacccatgagagaaggaactgtgccaatgtcacacatggacacatacatcatttagtgcccttgcaccttactcaaaaatttatttctggaactaccacattaaaatatcatcccatcccatattgtacaaagatttaagtgcaaaagttttaccataacatggttaataaaaaagaaagattagaaatgtttagatattcaataattgtggattgcttaaatactttataaaatatccaaaggatatactgttctattacgttattatactatctgatttcacaggcccttcaagttatcatcaaccctggtacctaactcctcactaccactcttcaatctgctctaagtgtcaattggtgcccagagactactcccagaagccattactgaaacctcagattcactgatttccatgccttgctgcccctgagccaggcctgcatcactcatcctacaatacctgatcacagagtcttcaattcctctaccctaatggtcctggctctctaccaatcaatcccacatccccatgactggcctctatgcctgtatgactaccgatcatgcatctccatcagccatcccaagagtcccaatcctaggcacacctgtttctgcactggggccttagcacacatacacatctcccaccactgacacaactaggctataagctcctccacatacacaaacaggaactcaatcaatgaacaaatcaggggaaattcttgcatgtatagaataaatttataaatagaaaacacttctaaatctaattgtgaaaaaccagactatttacagaggaaaaatgaaggaaataagaaaactcttcatctgcagtactgaaagctaaatgatgtcggaaatagcatctaaaagaccacttctctgtcagggccagagagacattttcagaaataaaagcacttgcagagtatctctatctttgagagaaacactggaagaagtccaaataaatgtaaaatgaaccacacaataaatcttgaataggaaaatattgtttagcaataattcttgcaaaagatatataattataaaaaaggacaatgtgacaatgtgataaagaggccactaaagagaaaattaataataccctatgataaaacattcctaataatctcaggaaaaaaacagaaaaaatggggtgcagaatggaaacaatgagcagaaatttcatcaatccaatgaaaatattatgtaaagaaaaggcagaaaataaaaagagctaaatagtaaacatcaaatggaaggcataaaatcagataaatcattatcacactaaactgagatgtaaaattctatcaacagagactataaattggatttgaaaaaagcaaaagtatctattgtaaacaaataggtaatctgacacagagacaaataggatacaaaataaagctctgggcaaagacatcatccaaatgcaatgaaagtaaaaacaagggtggcaatgtgagtatcaacgtggaattcgatgttaaaaagtgtttttcttggaattcgatgttaaaaagtgtttttcttttttctttttggttgaaaaaagggatcctataataataccacttaatacatgaaaaaggataaaaaatgcactaaccattaagtgtatgtatgcccatccctcagatgcacaaataaaattagcaaaaaagcacatataactgcaaaatgaactattaaaagtgatttttattgtatctcctccagaatatgaaacaagtagatcaaaattaggaaagataaagatttgaaaaataccaacaagcaagacttaattaaagagaattttggtccatacaacaaaatataatttttcttttatatctgttgaacaaagttcattgagtaacttggcttcaaggaaaatcttgataaattgttaaaagttgagacttgatagtctgcattttctgacaatacaataaaataaaaaacagctaaaacatactttaataatttgggaatgaataaactctcctaaataactaagattcaaagggaaacatcaaaatgaacttatgcatttcataaagatgtacttaaagaaactttacaaccctaaatgtatcccgcataaaacttaagaaaataagggaaagaacaacaaattacatcaaaaagtgggaaaaagagaaagtacctaaaaagaaaaagagaaaaaaattaatattaaaagagtagggagtattttattggacatttcaaaatgtccaatgaaacagataaacctttcagacgcttgattctttttaaatagagaaagaatgaatgatatataaatataataaccgtaatgataaaggagctactagtctggatatgaaagagaacaaaatggaaatggaaacatgcaattctatgtaatatattctttaaatctttagcaaaatatatcattataatgaaacagaaacgaaaatataaacagatcggtacgtataaaagagaggaaactaattaagatgtgcatcattcacactcctcagatccctccttagttcccatagtcatcctcccccacaaccccacagtccgccctcactccgccctcagatccaccaccagacagagacccccagtccgtcctcactccgcctgcagatccaccaccagagacccctcagtgccccctcactcctccctcagatccaccatcagagatcgctccgacttccactattccatccactgaccgaccccatcactgaccggaaggctcaggacagacatcagagattcttcttgctcagtccacagatgctgccatccctctactcacctgcccctcacccacgtcctctcaggacagtggtcatttgcctcgggaggtgactatagtcgcaagaaccagaacaggacccacttcctttttctcaat

SEQ ID NO: 501 - DNA, 31940 bp, Homo sapiens
tcatctccttgcacatttactattatttgcaggagcttgacaacaccaatatcaagtaaccaaagatggccactatacattgcttaaacactctcaaaagtgtctccccatatgtgtaactacacatcagctatatgatccagatgttcataattctaactagatagaagaaagttggccttggtcaccttctgagtccccacaccataattgtggcatggagcactctacttccccattgtcagatttctgaggcatactgagttgtggcttccagtttaaggctttccccaagtcactgcacttatagggtttctgtttagtatgaattttctggtgtttaataagatttgatctgatggtgaaggcctttccacactcagcacatatatatggtttctctcctgtgtgaattcgatgatgctcatggagttgtgatttcttaatgaaagacttgccacagtcactgcattcatagggtttctctccagtatgaattctcctgtgtctatttaagtgtgacttctggatgaaggatttcccacattcattacaaatatagggtttctctcctgtatgaattctctgatgcataattagtgttgattttcttgcaaaggctttcccacattcactgcactcataatgcctttctccagtatgggattgctgatgtatatggagacctgacttcctagtgaaggctttcccacagtcactacatttataaggtttctctccagtgtgaattttctggtgtgtaaagagatttgatctgtcagtaaaagcctttccacattcagcacacctatagggtttctctcctgtgtgaatctgctgatgtacgtggagctgtgatttcttagtgaaggatttcccacaaatactgcattcatagggtttctctccagtatgaattctctcatgtgtaataaaatgggatttgtggaagaaggccttaccacattcagtgcaaacatatggtttttcccctctatgaattctctggtgcatacttaatgttgacttctgaatgaatgctttcccacattcactgcattcataatgtctctctccagtatgacacttctgatgtatcctgagccgagacttccaggtgaatgattttccacagtcgctgcatttataaggtttctctccagtatgaattttttggtgcttaatgagatttgacctgtcagtaaaggccttaccacacacagtacatatatagggtctttctcctgtatgaattttctggtgtataatgagatttgtcttgtgagtgaagaccttcccacattctgaacatataaagggattctctcctgtgtgaattcgctgatgcacatggagttgtgattttttaataaaggatttcccacagtcactgcattcatagggtttttctccagtatgaattctttcatgtgtgataaaatgtgacttccggataaaggccttcccacattcagtacatacataaggtttttctcctgtatggattttctgatgcatacttagtgttgatttccttgtgaaagcttttccacattcagtacattcaaagtgtttccctccagtatgaatttttttatgtatattaaggtttgaattctgagggaggtttttctcacattcactgtactcataaggtttttctccagaatgaattctctggcatctgaacagatctgacttctggataaaggctcttccatagtcactgcatttatagtaattcccctcataaggagttttctgacggtttgacttgagggaaaaatccttctcatattcagtgcatattcctgcataaaccctctgactgccatcaagctgggacttctgagtgaagactgcctcacattcatggcattcatgctgcttttcttcagcacaaatactctcatgtgcaaaggcatgtgacttcggggagaaaacatttacgtagtcagaaaacaaatagaggctctctctagtatgaattttctgttgttgaatgagagcttgcttatgatgcagaggtttcccacattggttacattcacaagcagtcacttctgtatgagaattcaaatgagtgaaaatatcaccatctccaatagtcttatcagaattttctgttgcattgtttctattatataaggttatgataggctccaaattctttccacacgagttacagttatggggtctttttcttgaggaaaccaggtgtgtgtttacatgaactatttccccaatgtccttatattcaaagatgctgtcattagctagtgttttcttgttaatgaagacaacacgacttaaaggtttgttctggttttctccacattttcttgtgtgttcatcgtctttccacaattcttctaaaatggaatatgggtcatctcttgtgaagagattaatattaatctcagactggaaagaaacttcttcagacatcctctgttgtaaaggtccaaaaccaatgtccccatctaaaaaagaaagaaaagataagactgacaaaaagaacaattaacagaaaataaggccaggtgcggtggctcatgcctgtaatcctagcactttgggaggctgaggtgggcagatcacttgaggccaggagtttgagaccagcctggccagcatagcaaaactctgtctctgctaaaaaacactcaaaatattgtctctactaaaaattagccaggcgtggtggtacatgcctgtaattccagctactcaagtggctgaggcaagagaatggcttgatggcttgaaggcagaggttgcagtgagctgaaattgcgccattgcactctagtctgggtgacagagcaagactctgtctccaaaataaataaataaataaataaataaataaataaataaataaataaaaatacaatagacctttgattcaggccgggtgtggtggctcacgcctgtaagcccagcactttgggaggctgaggcaggcggatcacctgaggtcaggagttgaagaccagcctggccaacatggagaaacctcatctctactaaaaatacaaaattagccggacatggtggtgcatgcctgtaatcctagctactcaggaggctgaggcaggagaatcacttgaacccaggaggcagaggttgcggtgagccgagatcttgccattgcactccagcctgggcaacaagagcgaaactctatctccaaaaaaaaaagagttgattcaaggcagacacagagatatgagagagactatataaatataacaaatgtacataagtattttaaatatacataaatatataggtataataactcatttatatataatatgtaatacaatgatgtagagtaataatattaatactaacatttataacatgataaacaatatcatttagatgtgctgttctaagttctatattaattcacttaaactttatcacggcccggtgtggtggttcatgcctgtaatcccagcactgtgggaggctgagatgagaggattgcttgagcccaggagtttgagaccagcctgggaaacatagtgagacccccatctctacagaaaaatgaaaaaacaattagctgggcctagtggcacatgcctatagtcccagctacttaggaggctgaagcaggaggatcacttgagcccaggtgtttgaagctgcagtgagctctgatcgcaccattacactccagcctgggtgacagagtgagactctgtctctctctctctcttttttttttttcttttttaagacagggtctcactctgttgctcaggctagagtgtaatggcatgatcagagctcactgcaacctccacctcctgagttcaagggattcttgtgcctcagcctcatgagtggctggaactacaggcatatgccaccacaactggctaatttttgtatttttagtagagacggggattcaccatgttggccaggctggtctcaaactcctgacttcaagtatctgtccgcctcggcctcccaaaatgttgggattacaggcgtaagccagcaagcccagccaagaccctgtctcttaaaaacaaaaacaaaaagcactttattgtaaccctttgctgttggtattattattgtttctagtttacagatgaggaaactgagccacagaagagtttagttaaatttgcccaaatcaaatgtttagtaattggggaagaagagattgcaattcagtgcaaatgtagtagaactacatggtgagtgaggtgtcagaagaacaaagtgataaactctgtgaaaagaagtatttctgagtctagattcttttccttaatctgtaaatcctcacaatcttcctgttttctcttctccctatgatccactgtgccctaaataccaatgtatttatgtttacagtaaaattacgatatcttagtcatcctaacttggccaaacagaaaaatttatatacatttgttatatttatatagcctctctcatttatctgtgttttccttgaatcaactctatgtaacaattggtctattttcttttgagatggagcctcactctatcacccaggctggagtggctggagtgcaatggcgcgatctcggctcactgcaacctccgcctcccgggttcaagcaattctcctgccttagccacatgagcaggtgggactacagacatgtgccgccatacatgtatttgtaaaaatacaaatttttgtatttttagtagagatggggtttcaccatgttggccaggctggtctcaaactcctgacctcaagtgatctgcctgcctcagcctcccaaagtgctgggattacaggtgtgagccaccgtgtctggcctatggttcaattcttcatccctggtttggggtactgatgtgataaatgcatctggtagaagacataacaggaaagaactagacatcagaagagaagactgaaagttgttcatcaaacctgtgcccttccttcacaatattaagcttgtagccaagcacatggctgcttcacaacactaggtttgttcagcttcatttgtcactaggtggcactgagtaactctttttcactcatcagtggaagtgataaggccaatgtcttaagaaagtgggtttgtctcctacaaacctcttcttttcccaccagtatattccaacttggcagcacccagttctatgaagctggcaatgccctagggcaggggtcagaaaactgaagcccttgggccaaatccaggcctctatccaaaagctaacaatgtattttacatttttaaatggtcaaaaaattaaaagaagaatactacttcacgacatatgaaaattatatgaaattcaaatttcagtgtccataaagtttttattggaacacagccacacccatacattgatgtattgtctatagctgctttggggctacaactgcagaaataagcagttgtgacagtagccatatggtccacaaagcctatttacttttgtgcctttacaaaaaatttgtcagcccttgccctaggggatggtggtacaatgactttctagaaactttgtccctgaacggccatggaaacagagttgcccggtgttatggccatcgaaaagggactaacacacatctttccattagtcactgcagtctattttatcaatgaacccaaacatacagtcttttcattttctccatttaagcttcctttttctgatcttttgtttctatcaaaaattcattgttcttcattaatcatttggggttctctgctttaaaagctaatttcaaatttcaccacaactctagagaggctctcttttaacttaaaaacaaacaacaaaaaggtactctgaaccactcatatttatatttgaattggcatagatgtgcacgttaacaaaagtgtaatgcacaaagactgaaattttcaagatttcatgcagttatcctctttccaattagtttttctagccctttgaattgctcctaaaagaaaaattttaaaatctttctgaaatagagcaaaacgacctcctctgcttataacacaaattcaggaatttaatttcactattttctacagaaactttgcattttaatgtacaagagtaaaagcctcagttatcatgtaatttaatgtaggtttctctgaatttctggaggttgtatgctgcaataggtcaaattcaaggagtaagtgaaagctgagcacaaaatatgtgtattatttggttttttgtttgtttttgtttttgtttttgttttctgagatagagtctcactttgttgcccaggctggagtgcagtggcacgatctcggctcactgcaagctccgcctcctgggttcacaccattctcctgcctcagcctcccaagtagctgggactacaggcgcctgccactatgcctggctaattgaccttgtgatccacctgcctcagcctaaagtgctgggattacaggcgtgagccaccacgcccagccttttttttttttttttttttttttgagacggagtgtcgttcttgtcacccaggctggagtacagtggcgcggtctcagctcactgcaacctccacctcctgggatcaagtgattctcctgcctcagcctcctgagtagctgggattacaggcccctgccacctcgcctggctaattttcatacttttagtagagatggggtttcgccatgttggccaggctagtctcaaactcctgacctcaggtaatccacccacctcagcctcccaaagtggtgggattacaggcgtgagccactgtgcccagccaaaatatgtgtattatttgaatacgcagatagataacataataatcaaagggctcgatgaaaagggagaattaaagaaaatcttaaaataggatagaaatggttatagaaaacagggacaaatgtgaattgcaaatatgaggccatattctttctctagcttacaaacctactgagaggagaatctgtcacatgttagatattaagtagtaactttagttttcttccatgtagctatgacaggataaacacagcacacaatgttttaagtagtgaaatctatcagcagcatctgagatgaaatagtgaaaaagaaagaatgggattatcacatacaaataggattagaataatctaggcatgagaaaacacagacatggttgtaggtgatatgactgggaggtaagaaagaggcttttgtaaatgagaaaaataagtagaaaagcagaatgaattatctgagaagatggattagagggaaaagtaaaaaaactccaagagaagatgacaacattttgaaaggcaagccacctgcttttacatgctacattgtatcttgtcttccttcacacaaacagccagacccttaaatgcaaacagtattggtctttcccctgagtgctgtatacaatagggccaatgcctgactgagacacacaaataacagtcacagagtaaaagttgttcccatgagccaattatcactcagagcttatgctgcagctgagacacataatctaagacacagattatgctgggctgagacacatggacctgggcaactttaaggagggcccaaagcccttacacctgcctctaaatgtccatgataacttctaatgtaggttagttatgtataggacagaggcaaagtgcatacttgccagcaggcagtataaccagttgggaagaggagaaagacccctgtgggggtggtcattgccttgacatcctgcttattgccccagctgtaaatgacctgcaaggagaaatggaccccaccccaaacttggttcagatgtcaagagtgacgatgagacacacacaataagagggtgtaaaaagatttgttactcacataatgaggctttctggggacagctccaagcaggtccagatggggctagagtgagcaaggaaaggactgtcttgggagtttatggcaggggcgggtggggctgggctaactattcccttatgtagttggaatttcccagcaacaatggagggaactcatgggcttttttctcagtttgtccaggaaaaaaagagagagagatgaggcttagaaaacatcagcagttgaacatcaaaaatgaaggatacagaatgagatgttcaaagtattttattagggaaatacaaattaaataataattagaaattaaaacccatcagattagccaaaatattaaaaatttggataatactaggtatgggtagggatgtggggaactaatacccttgtacaaagttccagggaccgtagagtgacacagccaatctggaaaataatgtgcttatacctcatcatattcaatattagtatgcccaatgataaagcaatcccactcctcttccttaagaaattctcatttccggctgggcgtggtggctcccgcctataatctcagcactttgggagtccaaggcgggtggatcacgaggtcaggagatcgagaccatcctggctaacatggtgaaaccccgtctctactaaacatacaaaaaattagctgggtgcagtggcgggcgcctgtagtcccagctaccggggaggctgaggcaggagaatggcgtgaacctgggaggtggagcttgcagtgagctgagatcatgccactgcactccagcctgggggacagagcgaaactccatctcagaaaaaaataaataaataaattatcatttccagtaagaataattcatgaagaaatgtattgcagtactgtttgtagtagctgaaaaactggacaagtaaaatggggtatatatgtgcactacagaatgatatgtagaaattagaataatgcactgcaacatggaccaatttgagaaaaaaaaacttgagtaggatatataatacagtaccatttctacaaattaacaatgccaacaactcagattttataaatatcccagaaattcaaggataaatggcataacatgtcaaatatattagaacagttgcctcttggaaggataaaaatgagtatggagactgaggattaaaaagaataaataagaggggagccttaaacacattgatgatgatattgactaaaaactaaggctataattattaactcaatcttctgtacaggatatacctgtacactagataaaaaactttgtgtaagatatgaaaataaataaattagaaagatcaagtcagtgttgcgttgcactagccaagtaggaagaaaatgtcaatggtactctcaaagtcaacaatcagagaagaggcatggggggacttcagacaagcccatctctagatgacaattgtgaggcactaaggggaaagagacaaaatgagaagaaacagcaggagctgaagttgtaatgcatagtaatgttttcagaaggtagatctatgagtatttgaatgcataaggaaatgatctaagaccttgatggaggtagaaagaataaaacttttctagggaaagagagaaaaaagcaagaaaacaggaccctagaaagtagagtgtgacatgatccaaagaaccagtaattgtagcatattccctcctaaaaagccaagcaaagaagaaggcattgatatgagaagggatcttaagtggggttagcatttagctatccaagggtccttgtctaataactgctcttccaagcagttctaaaagtcattattaatgacacatcaaagttgggcaaagttgggcacagcttctcccagtacaaatgcagctgagtcatactgtctaccatgctcttggttcccttctcacctggacggctctgactggggatctcaccatccaacatacatggctcttcttgttccaagctgaagatgacttctggtttgggaacttgacatcctgttaacaggggatgatagaggacttgatttcagaggccatacaatgaagcattccatttttttcccaaaaaagttcactgggaacagaggaatattcacactacccgaaagagattattaagaacatgggacaaaataaggacaaaaccattacacactttagatgtcctgcagtctttagaagtcccacatacctcagaaaacacagacttcagcaattctactgagaagaaaaatatactcaattaggtgcagcctactctatacccagcagagccgtgcttacccactgagatcaagttgaaatagttttccagcatcacttctctgtacaggcttttctgagcaaggtctaattgttgccactcatccctactgaagtctacagttacgtccttgaatgacactgattcctgttaaaaaaaaaaaacaaactttaaaataattttttaaagaatatatttgaattcaaaaaaaaaaacctttcaatgtgaaggatcgagattacagaatggaaacaagataggaccttatttttaatgtgatacaatatactataaagaacttctacaattcaacgacaacgaacaaaataattttaaaaatgggtaaaaagcttaaatagacatttctgcaaggaagatatacaaatatttaacaagcacatgtaaagatgctcaacgtcattaatcactagggaaatgcaaattaaaactacaagatattacctcacacccatctggatgataaagaaaatgtctaaaattgattataatgatggctgtacaactgagtgaatacactaaaaatcaatacatggtacactttttttttgagacagagtctcgctcagtcgcccaggctggagtgcagtggctcgatctccactcaccgcaagctctgcctcctgggttcacgccattctcctgcctcagcctcctgagtagctgggactacaggcgcccgccaccacgcccagctaatttttaaaaatttttttagtagagacggggtttcaccgtgttagccaggatggtctcgatctcctgacctcgtgatccgcccgcctcagcctcccaaagtgctgggattacaggcatgagccacgacacccagcctaatatggtacactttaaatggtaaactgtgtggtgtatgaaggagagggctctttttcagcactgccatttccagatgagatgcagtagcttggcagtccagtgcttccttcaacaatgaactgtaaatgccagacgcaatacttgaaatcatctgtttcaaagcactggaaagctgctgaggtagcaagaaatataggggctaagactggagaggagagaatattaaagattgaagctgacttattcagtcactctgacagtgggagcatttaccaattctggctgtggacaaaagctgagaatccagcttttgtcctggattctcattttgtcctgtctactggagaatgcagtagaaggctgcagctgggtgacagagaaaccaacataactcaaacacatggccattttcccctcaggatatttgctgaattctagggtatatagggcagtagactaaaaatgtaagcaaacagcctttgaagaacagagcaaaagtctagtatctgttaagaaaatagttgggcatctatcaggaagagggtctttagaggacaaaagggctctcagctgaaaattctcaggagccagggtgatccagaggtaaagtgagtcttagcagagcttcaacccggccttatttcaacatcaacagtgcctgactggatgtacgtgttctcccttccctccatttgctaacataaggaaagatgaatcctctgtggagaaagattttttttttcttttcttctgagacagggtcttgctctgtcatccaggctggagtgcagtggcacaaacacgactcactgcagcctcgacctgggctcaagcaatcctcctgtctcagccccacaagtagctgggactacaggcacatgctaccatgcccagctaatttgtctatcttttgtagagatgggttttgccatgttgcccaggctggtctgggactcctgagctcaagtgatctgtccccctcagcctcccaggtatgagccctgcctacaacttattatacacagtgtttaaaacaaacaaaaaaatcctacacatccaaaaagataggaccacatatccaaaatcagagaaggaaaaaattcaatagaaacagtcacacagagaattggagttagatgaaaagaggactatctttagagagttggttcttataataaagaatcaaatgaaagttcaaaaattgaaaaatctaaaatctaaaattaagaagtccttatgcaggtttaacagcaaaatacagaatttctgaaatggaagacaagtaaatagaaaatatccaaactgaagcagagattttttttttaaagaaaaaaacataggagcattaggaatatgtgtgacatagtaaaaaaggtataacctatcagagtctgagaagttaaagaggagagtgcagggaaaaagcaatatttgaagaagtaatggctatgaatgtcatcaacccttaggattcaagaagctcttcaaatacctctttacaaaactgcaagtattgactatgcaaaacagtaacagtactattctgggaggtttaaaatgtatgcaaaatttaaaataatggaaataataatgcaaaaatgggaggcagtaaatagaattaaagtgttttataaagtatcctagcattattaaggagataaaatagtaagttcaagatgaatgttttaatatctggggtaacaaacagtaaaagaattataacaagtaaacaaaggaaaaaattaaagagtaaaaaaattatgtaatataaaaagtcaagaaaggaatgaaaaaataggtagttcaaataaaaactaggccgggcgtggtggctcacacctgtaatcccagcactttgggaggctgaggcaggcggatcatgaggtcaggagatcgagaccatcctggctaacacggtgaaacccggtctctactaaaaatataaaaaaattagctgggtgtggtggtgggcacctgtagtcccagctactcaggaggctgaggcaggagaatggtgtgaacccaggaggtggaggttgcagtgagccaagactgcaccactgcacaccagcctgggcaacagagcaagactccatctcaaaaataaaataaaataaaataaaaactaatagtaaggtggtatatataaattcaagtatatcagtaattacattaagtgtaaatgcattaaacatccaagttaaaagcaaggattgagacttctggttctaaaaaacaaaacaaaaaaaagagtgcattccacccaattcctcctgctaattacctaaaaatctagaaaaatacataaagcatctgtcagaagactcactggtggagaaaagaaagtagaacctaaggacttaaaaaacaacacagtagtgagttagttccctagagggaacttagagggagagagggagctcctacatattgcaaaatgagtactagaggagcttgcaacctggaagaaccaatgagcacagacaaaaaaggcctccccaaagcatacattttccagccaaataatttgaaatagggcagcaatgcaggatgggaccttttgactacacatacctacaaagttcagaagtacccaagaacaccctcacttctgacacctactgcaagcagagggatttcccaggatcacctgtacttctgacaccaattccaagtcaggggtccccaggaccaccctcaggttccacaattcacagaagaactcacagaaattagaaaagccataatactcatggctatggtgttatatagtggctttacaatgaaaggatacagatcaaaatcagccaagggaagatgtgcttagtgcagtgtcaatgagagttccaggtgtgagcttccagtggttttctcccagtggagtcatatggacagcacttacttctcccagcaatgatgtgtgatgataatacgcatggagtattgccaactggggaagttcacttgagccttgatgtccagagtttttactgagacttgatcatgtggacatgaatgactcccactgtggctgatcttagtctccagcccctccagagctgatattgcatggccaaaggtaccccactataaaccacatgttggcatagaatattcagtgtggcccaaagctcccaccataaatcacactgtcattatatactatcttgcatggcctaagcaaggcctgcaggacattccaaagatttagaggttacctcccaggagctgagtgcaaaggccaaacctctctttgggcaaagttaatcctttactgcacaacaatatacttgaggccaggcgcggtggctcacgcctgtaatcccagcactttgggaggccgaggcaggtggatcacgaggtcaggagatcgagaccatcctggctaacatggtgaaaccccatctctactaaaaaaatacaaaaaattagccgggcatggtggcgggcgcctgtagtcccagctacttgagaggctgaggcaggagaatggcgtgaacccgggaggcggagcttgcagtgagctgagatcacaccagtgcactccagcctgggcgacagagcgagactccatctcaaaaaaaaaaaaaaaacaacaaaacaaaacaaacaaaaaaaaaccagtatacttgaggtgaaaactacaaaagatgcatcctttgccttcttcacaaacaatgtgactccaaagatggtggggtggagctctctcaatcatcccaactgcattagctcaaagagaggtagcacccctcttgcctctccagcaggcattatatagactgtattggctaaccctaccccaaattaagtgaatgacagcaaagaagaagtagctaccttcttccaatagagagtggaggatggattatggagaaagttataaaaaggggttctttaaatacatgtatgatgacctgggcacacctacgagcagcccagatataaaatgaatcagaatcaacatagaaaaagctttcagggctgaactagggtgtgggatactgtccaggtttcaaattagcttctgggtagcacaaaaatgagggagaccaaaatagaactgcaaagactttcaaaactaagttgaatttgaaatacagcccataaaaatagaccaagacatgcactctaaacctaaatgtgttgacaactgctaaaatagaggatttgaagagaaaacagaatctcataacatgatattcagaatgtcctgaataaagccaaaattattcatcatcttaagaaccaagaaaatctgaaatcaaatgagaaaagagcatcaacagatagcaacactcagatgaatcagatgttggaattatttgacaaggatttaaagtagctaactaaaagtgttgcaacaagcagctgtaaatagtgttgaatcaagtggaaatatataaattctcagcaaagaaatagaaggtatgaggaggaacaaaatgaaaattttagaaccaaaaaatacagtaagtgaaattaaaaacctcactggatgatctcaacagcagaatggagatccaaaggaaagaatcagttacctcagttacctgtaagatagataaacagaaattatccagtctgaacaatagaaaaaataattgatgaaatgattgtttcatcaattccctcaggctgtattcagcctaagggacccagcgggacaataacagaacagccaacaatcatttcagcagtcctagaaggaatgaaaaagtaggacgggagactggaaaaagatatgaagaaataatagctgaaaacctcccaaatctggtaaaaggcataaatgtacagattcaagtcgctgaccaaatctccaaaaggaaaacctcaaataaatccatgtctagatacattgtaagatttataaaatccaaatttaagaatagaacctgaaaacagtcagagagaaatgacacattacatgtagggaaagggcaatttgaacaagaatgactttctcattaaaaaccacagatgtcaaaaggaagtgggaccatatttttcaagtgctgaagagaaagagctgtcaatattgaattcaatatccagtgaaaataaaataggctctgtttaaattctcttaaacttaattctgaggaattacctgccattggtagttgagaaagaagtctgaaaaaaaaaataaaaaaagaattaactgccatacatttattaagcataattacttaggtaattcttaggaattacctgccatatatttactaagcaagatgttgagaactttatgttgtgaacatcttcacaactttacacaatatgcttcaagacatcaaagaacttacaacaactttctaagatattataaagggcataagagatgtgcaaagcatagcatgaccccaaatagagagaagaaaattctacatggagtgtaagactaagttctgtagagttgatgaaacttaagcttagtcttgggagatgccatgtttaatgcaagcagagtagggcaaagtgatttttagaagggagcagcatgagcaaaggtataaagacaggaaaatacatgataaattcagggaaccacaaattagtctgcataatgagaagtctgtatgcagtgaaggaaaggtgtttatgaggaaatttcagtagaggtatgctggcatgagatcatgcaactatttttcctccaatacataatggactgccattaaagtaatttatatatagagaaaagattattagatttatgtttacaactgccaagaagatgctggccaggttgtggagaaataggaacgcttttacactgttagtgggaatgtaaatttgttcaaccattgtggaagacagtgtggtgattcctcaaagatttagaagtggaaataccatttgacccagcaatcccattactggttatatacccaaaggaatataaatcattctgttataaagatacacgcatgcatatgttcattgtggcactattcacaatagcaaagacatggaatcaacccaaatgcccatcagtgatagactggctaaagaaaatgtggcacatatacatcatggaatactatgcagccataaaaaggaatgagatcatatcctttgcagggacatgcagggagctggaagccattatcctcagcaaactaatgcaggaacagaaaaccaaacgctacatgttcttacttataagtgggagctgaacaatgtgaacacatggacacagggaagggaacaacactcactggggcctgttggggaagggtggggggtgggagagcattagggaaaaaagctaatgcatgctgggcttaatacctaggtgatggcttgataggtgcagcaaaccatcatgacacacatttacctatgcaacaaacctgcacatcctgcacatgtaccctagaacttaaaataaaaaataaaaaaagactatcaagaaacagcagggagaatacatttgaatgagcaagagtggaagtctaggcaatatttcatgtgaaagaattaaaacaccttagttagggagaaaatattatttaacaggaatatagaaaaagaaattggtgtagatagtaggtaattagaattgatagatggagtaagaaaaaggaggaactaaagtgaaattctcaattattcgttttgtatactctgagattatagtgtcatatactgaagtagagattgatgaatggaaaaggttggagaaagggaaccagatgaaatcacttatgttttgcacatattgagattacagggattaaacatgtaggcaggcatattataggacgttaggcagaggcctagagtggagataaagatttgggagtcaccagtagataattaataactaaaatcatctgagtaaatgagactgcttgagaggacacctgataaaggagaatgtaaaggaaagaatctgaaaaagttaccagcattgaagaagaggtgtcagcaataaaaactgagaaatcggacagagccaggagagagtaacgtcttagaatgtatgtggggattagttgatggggttgaatgccaagatggatgaaaaaagcaaaagacagataaattctggcttttgtatttaggagatgtgacagtgatagctagttgtcttccaacattcactcatcctttcttccctaataacagaacatgaattcttagctggctactctgagtaagactttcttttcccagcccaccttaaatgtaaccaggaaactatactttggccacagagatacaggcgatacttctgagatgtcagtttttaaaggagaaggtgtgagtgcccctttcctccccaacctcaccatgctgctggcctggaacgctgactcagttaatgcaaccccagcaaatctcgggaactatcaagtgacgtgaggttgaaaatcacaaaatgagaatgacatagagaacaacaacaaaaaaaaaaggtgtataaatttgtgaagacatcaggccctgaatgaatactttcagacttcttttgcttcttttgtgtttaagcccgtaattcttagatttctgttatactaaaatgcattttgccagacaattctaataaaatagatagaaactgggttgcaattacagactcttaagcttttaagcaaaaaattcagtaccacgtaatagcaaaaagatcagtacttcaggaaaatataattcatattttgaatgacaatctaaaatacataaaacaaaagttgacaaaattacatggagaaattgataaacctacacacgcatgggagacttcccaactccccctccctactctgagagattttaaccagattacattcattaatcactagatatagcaacaaaaatttggcacatataggaaaatttctgcaagaaaattgacaagccagttacaaaggagatgagatctcacacataaaacaaatatgcaatagtcaaaaaataaggattatacagaagatctgaacaacacaaataagctgtttgtgatgtagacagaaatcacacacacacacacagagagagagagaaagagagagagagagaacgagagagaaagagtatattcatcattatattaggggaccatacatgaatgacagtgtgatagtacacaaaatgtaaaaagaacataaatgtaacaacaggctgggtgcagtggcacatgcctgtaatcccagtactttgggaggccaaggcaggaggattgcttgagtccacgagtttgagaccagcctgggcaacatagtgagaacttgtctctataaaaaatcaaaacaaaaacaacaacaacaaaaagcaatacaaactacagacaactcagtttaaaaaaaagggggaggaatgaatcaagcaattctcaaaagaagtgtacatgacaatgaaattctgaaaaactgttcaatcacattagtaaccagggaaatgctaattaaatccaaaatgagatacctctgcaaactcccaagatggctaaaattgtaaagattgaaaacaccaagtactggtaaagatacaaagtagtaaacatatctgcacactactggtaggaatacaaattggcgtaacaaactttgcaaagctgtatgacatcatatactaaagttggagaggggccaggtgcagtggctcaggcctgtaatcctagcactttaggaggccgaggcaggaggattgcttgagagcaggagttcaagactagcctgcgcaacatagcaagacgccgtctctacaaaaagaaaaaaaaaattagccaggcatggtggcatgcgtctatagtcccagctacttgggaggcaggggaagcaggatcacttgagccctgaaagttgaggctgtagtgagctgggatcacagcattgcactccactcagcttgggtgacagagcaagaccttgcctttggatagaaataacttctgaaagaaatgttcacaagagcatatttcgtaatgcattttatatttctccatagtaaaggcttaaaaataaatgaaaataaaatcataatggtacagaaatgcatatggtataccatcttctgtggaaagaacataatacttttcctatttgtttttgtctatataatgacactttgaacacacactaaaaaaaattagttatccagattgaggacatgggctgataggaaaagaaagagggagatttttcactatgtacttattttcttacttttaaatcatatgcatgtattacctattcaaaatactcatctgacaaaggtctaatatccagattctacagggaacttaaaaacacatttacaagaaaaaaacaaccccatcaaaaagtgggtgaaggatatgaacagacacttctcaaaagaagacatttatgtggccaacaatcatacgaaaaaaagctcaacatcactgatcattagagaaatacaaatcaaaaccacaatgagataccatctcatgccagtcagaatggctattattaaaaagtcaagaaacaatagatgctggcgaggctgtggagaaataggaacacctttacactgttggtgggaatgtaaattagttcaaccattgtggaagacagtgtggcaattcctcaaggatctagaaccagaaataccagttgacccagccatcccattactgggtatatacccaaaggaatataaatcattctactataaagacacatgcacacgtatgtttactgcagcactatttacaatagcaaagacacagaaccaacccaaatgcccagcaatgatagactagataaagaaaatgtggtacatgtacaacatggaatagtatgcagccataaaaaggaatcagatcacatcctttgcagggacatggatgaagctggaaaccatcattctcagcaaactaacacaggaacagaaatccgaacactgcatgttctcactcataagtgggagttgaacaatgagaacacacagacacagggcagggaacaagccacaccagggcctatcaaggggtggggggataaggggagagagagcattaggacaaatagcaaatgcatgcaggcttaaaacctagatgatgggggccgggcatggtggctcacacctgtaatcccagcactttgggaggccaaggtgggtggatcacctgaggtcgggagttcgagaccagcctgactggagaaaccctgtctctactagaaatacaaaattagccgggcacagtggctcaagcctgtaatctcatcactttgggaggctgaggcgggtggatcacgaggtcaggagatcgagaacctcctggctaacacagtgaaaccccgtctctactaaaaaaatttaaagaaaattagccaggcctggtggcaggcgcctgtagtcccagctacttgggaggctgaggcagaagaatcccttgaacccgggaggcggaggttgtggtgagctgagattgcgccattgcactccagcctgggcaacaagagcgaaactccatctcaaaaaacaaagcaaaacaaaacaacaacaacaaaaaaacaaacctagatgacaggttgatagatgcagcaaaccaccatggcacgcatatacctatgtaacaaacctgcacattctgcacatgtatcctggaacttaaagtaaaattttaaaaaaagaaaatattgcacccatgaatattagaaagatcattcagaagtgaagaaaagagtccttaaaattaaaaatacaatattaatgagaaactcagtaacctgaaactttccatgatactgcactgagcacatcttctctggctgattttaatccacgtcctctttctgtaatgaactataagcatgagtataatggctttcctgagttgtgtaagtccttctcgtgaattattgaaactgagggtggtcttggagactcctgagcttgcagtttctgtcataagtgagggtagtcttagagacgcctaaataattttacttgggcttgtatctgagtgtcaatagggctgtattccttctggaggttctaaaggaatatcaatttccttgatttttctagcttctagaggccacctgtattctttggccttaaaacaacacaaacttgtcactattctggaggtcatatgtccaaaataggtcctgctgggctgcactccttctggagactctacaggacaatccatttctatgtcttacccagcttcttgagactcaagagatctaacatttgagaaacatgaggacaattcctagtatcatgtggaagggacagcccatgccagtagctgagtatcggatagagagtaactatgagcaggtcgacaactccaagaggagtttctttaaagagctgaaatgaatagcatgtaatctagagccaacggcctgggtcttattttcctggcttcatcattcaggagctgtatgatcttgggcaaattccttctctgtgtaacagttttcctcctctgtaaaatgagaataatgattatagatagctgtctttgtttactgttactataaaagaacacctgagcctgggtaatttataaagaaaagacatttatttggcccatggttctgcaggctgtacaagaagcatggcatcagcatctgcatctggggagggccttcaagctgcttccattcatggcagaaggggaagagaagccggtgtgtgcagagatcatatggcaaaagaggaagaaagagagagcgaatgggaggtagcaagctcttctcaacaaccaactctcacggaactcataagattgagaactcaccacctccccagagagggcattaatctattcatgagggatctgtccccatgacccaaacacttcccattatgccctaccacctcctacactgggatcaaacttctcttttatttttaaaatttctttttatttatttatttttgtaagaaacagggtctcgccatattacctaggctgatctcaaattcctggcctcaagtgatcctcctaccttggcttcctgaatagctgggattacacacaagccaccgcgcctgggttgggggatcaaatttcagcatgagatttggagaggataaatatccaaaccatagcaataactcgtaggggttgtgactgaattagttaatagagaatgcttatagtgcctggtatatagtaagcactatattaatgtttatattatattactgttattatttagtatattttaatatattgagaaggtatttatatacctgggaagactagcgatgaattactgatatgtataatatatattgtacatgtatgtatggaaaacaaaacaaatgattaagccagacacttataatttcaggtaaaacaaaaagcactgcataaaaagtaaatggctcacttgtgaatattgttaaaataatcatcataataaaatgcagcctattgatttaccccaaattatgatatacccatattaggctgggcgcagtggctcacgcctataattccagcactttgggaggctaaggtgggcagatcgcttgagcccaggagttcaaagatcagcctgggcaacatggtgaaaccccatctctactaaataaataaataaataaacaaaatacccatattagatggagggtacatgagaaatgtgtacgtgagtgtcaagggcctgagtgtctgaaagagagctaattccttctttccattgtgttgtctgtagataactgcttaaaactgaaagcctagaaataccaatacaaacatgttatttagacatatgaaagtaaacagcaaaagataactaaactgagttcaaagtgattacctttgagaagctgaaatttgaagaggaatagagcagatgacaactgttttattctaagaaaccacaaagaacaatttgactaagtaaatataggtaaaactttcatgacattcaaaatgaaatacttatttttaaaagttcaaatgcaaaggacaaagaggcagttataactgaccaaaacgtataagactatgcttaatatatgaagtcctctgttcaaactcaataaactggattccactcctggaaagatacagtagatgcacttgtctctattcatcctgttaagttcatctacaaaccatagacattatccatcaaaccaacatacagactctgaaaggtaaagaaaaataggcaccctggctaggggcctcaggaaccagggaagtaaacagtaataagctctctgtgtctttcggcctcatatagatagctctgaccaggtgttcgaaaaacctacaatccagaaacatcaacaagtgcatacaaaaaggcctggaaaaaagtgttttctctagctaaaagaccaggaaaggggcaacagagaaaaataaaaaacttttagacaaaacctactccaaccaaataccacagattataaaacaacaaaaaactgtgggcttgattcatctctcatcagcaaagactcagtgggtagcctagactcctgtatttgcctggctgcctggggatgcccctccactgcaatagggtagtatgagaaaagccaactggggagctgggactttcatctctgcacagtggtaatgggtagctttcttgccatgccagtgggagccacctcagggctggacttccattcctacctagcagtaatgcgacactcttcccatcacgacaggtgtggtgtgagaggatgtcaaatgaaaacccaagaccttcatcactctgagaggtaatgaggccctatccaacctaacaatatcagagaagacagcatgaagagcagaaacaaggtaccctctcctttcagacaaggtgatgtcaccagaggtctactggggagcctgaactgccaaccccaactagcagtaatgaggtgtctctctccccacagactgtcaacagagttcaagtagggaacctgcaaattcacatccacctggcagtagtacagcaaggccccccaattcccacactggcccagaggacgcctgctaaaaaagaggactcaaataagatctagagtctcataatgcccaaggtttccacaatacattacaaaatcatttgtaaaaccaagaaccaggaaaatctcaacttgaataaggaaacaaccaatcaaccgatactaaaactgaagtgatgtatgttatcagaattatttcataaggattttaaagtagtcctcataaaaatgttttaacaagcatatgaacacacttgaaacaaaaaaacttcaacaaagaaatagagaagagatgaaaaaaccaaatgaaaattttagaattaaaaaataaccaatattaaaaactcaatagatgggctcaaaagaatggaggcaacagaagaaatattctgagtacctgaaaataaagtagaaatgatctaatctaaagaatggagagaaaacagactgagaaaaaaaggaacagaacctcagagacatgtgggacaataacaaaaaatctaacatttgtgtcattggagttccagaaagagaaaaagaagagaaagggatgggggctgaacaagtatttgaagaaataatgaatgaaaatttctgaaacttcccgaaagatatacacttacagatagaagctgggcaaatctcaaaaaggataaaaccaaagaaattcacactaaggaagaattatagtgaaacttgtgaaaaatacagacaaagaaagaatgctgaaagcattcagagagaaactacacattacccacaggagaaaaacaatttgaatgacaatgtgagatactaagaaccatggctccccaaagatgttcacatcctaattcccagaaattgtgaatatgttaggttgcatggcaaaagggaattcaggtttcagatcaaatctaggtggctaaatcggctgtccttaaaataggaagattaattatcttagattatctgggtgggctgaatataatcacaaatttgcttaaaagttaaagcaggagggccaggcgcggtggctcatgcctgtaatcccaatactttgggagggccaatgcgggcggatcgcctgaggttgggagtttgagaccagcctgaccaacatggagaaaccccgtctctactaaaacatacaaaattagcagggcgtggtggcacatgcctgtaataccagctactcggaaaggtgaggcaggagaatcgctggaacccggaaggcggaggttgcagtgagccaagatcgcgccattgcactacagcctgggcaacaagagcaaatctctgcctcaaaaaaaaaaaaaaaaaaaaaaaaaagttaaagcagaggcaataaaagagagtcagagaaagatgcgactacaaaagagtggtcagagagatacaatgttgatggctttgaagttggaggaaagggccacaaactgaaatgtgagcacccactagaagctagaaaagtcagaaaatagaaacagattctttcaggttgcggtgagccgagatcgcgccattgcactccagcctgggcaacaagagcaaatctctgcctcaaaaaaaaaaaaaaaaaaaaaagttaaaggagaggcaataaaagagagtcagagaaagatgagactacaaaagagtggtcagagagatacaatgttgatggctttgaagttggaggaaagggctacaaattgtgaaatgtgggcacccactagaagctagaaaagtcatagaaaatagaaacagattctttcttacagcctgtagaaaggaatactgccctcttgacaccttggttttagttcagtgagacccatgttggccttctaaaatatagaactgtaaaaaaaaaaaagttatttttaagcaactaaatttttgaatttatttcagcagcaatagaaaattaacatgcagttttaactaatatctcatcagaaactttggaggccagaaggaagtagcacatttttcaagtgctaaaaaaaaaaacaaaagaactatcaacttagaattttggatcaggcaaaaatatccttcaggagaatgtggaaatcaagacattctcagtcctccaaaaattcgtatgtttaggctgtaacccctaatgtaactgtatttggagatagggcttttaagaggtaattacggttaaacaaggtaggggtcctaatctgataagacaggtggccttacagagagagattctctctccataggcaggcaggcaggcaggcaggcggtcactagggaatggcctgtgagcacatagtgagaatctggttttcgtctacaagccaagaagagaaccctcatcagaacctgaccatacttgcaccctgatctctcagttccagcctcccagaactgtgagaaaataaatttttgttgtttattccacccagtctatggtactttgttatggcagcctgagctgactaagacaactactaacagctctgcacacataaatttgacaacttagatgaaagggaccagttcctgaaaaacacacaaactaccacaaccctctcaatattaaatagacaatgtgaatagccctgtaacacttaaagaaactgagtttgtaatcttaaaacttccaaaaaagaaatctctaggcccagacagtttctctggagaattctaccaaatatttgaagaattaacataattaacataaattctacacagttttttccagaaaacagaagagaagggcatacttcccagtttattgtgtgaggctatgatttccctgacacaaaaactggacaaagtatagaaaaagaaaacacaaactatacacaatctctggcagaataatcaatacaaaggaacacattccaacttattttatgaggtcagggttatcgtgatacctaaaccagaaatagtaccaaaagaaaaaacagaaagagagacagaaagaaaaaaaaaagcgatatccttcataaatatgatacaaaaacccttaacaaaatattagcaaatacaaataatttaaaaagtatataccacaaccaagtggagtttattccatggatgcaacgctggttcaatattaaaaaatcaatcaatgtaatctaccataccaacagactcaagaagtaaaatcacatgatcatgtcaattggtacagaaatagcatttaacaaaattcaactcccattcacgataaaacctcaaggttgtttcagaaggtggtccttggacaaggagcattgatgttctgtggaaatttgtgagaaataaaaattctcatatcccatcccatagctactaaatcagaatctgaattcaaatgcaagtaaagtgtcagaagcactgttctataagacagcaacagaaaaactgttagtgcacgttctttctttctttcttttttttttttttttttgagacagagtttcgctcttgttgcccaggctggagtgcaaaggcgcaatctcggcttactgcaacctctgcctcctgggttaaagcaattctcctgcctcagcctcctgggtagctgggattacaggcgcccgccaccacacctggctaatttttgtatttttagtgcagacggggtttcaccttgttggccaggttggtctggaactcctgatctcatgtgatccacctgcctcgacctcccaaagtgctgggactacaggtgtgagccaccgcgcctggcctgttagtgcactttcagtagggttgttgttgaagactgctctgtcattaaccatctgaagatctatcaaaaaattcctcaaacatcaagaaccatgacatctttactacagatgaaataaattacttgttaattttattaatataaaccatgtatccaatttccattattgctatgtctttcaggaagatcagagacaatttaacagttcaaagttcatgactgtgtaagaccatatattctaaacttgacttggggctgacagtctcttcttcattttatctgatcttagtttttatttatttagtcttgtcatcttactatagggattgttagatgtctcctaaaatccactaaaagtaaaagaaagcaacaaataaacagatgaacaaataagaactcaccagggacttggtcatttttggctcttcggacaaaggggcagaaatctgagaaaacagatgggtagaggtacccatgagagaaggaactgtgccaatgtcacacatggacacatacatcatttagtgcccttgcaccttactcaaaaatttatttctggaactaccacattaaaatatcatcccatcccatattgtacaaagatttaagtgcaaaagttttaccataacatggttaataaaaaagaaagattagaaatgtttagatattcaataattgtggattgcttaaatactttataaaatatccaaaggatatactgttctattacgttattatactatctgatttcacaggcccttcaagttatcatcaaccctggtacctaactcctcactaccactcttcaatctgctctaagtgtcaattggtgcccagagactactcccagaagccattactgaaacctcagattcactgatttccatgccttgctgcccctgagccaggcctgcatcactcatcctacaatacctgatcacagagtcttcaattcctctaccctaatggtcctggctctctaccaatcaatcccacatccccatgactggcctctatgcctgtatgactaccgatcatgcatctccatcagccatcccaagagtcccaatcctaggcacacctgtttctgcactggggccttagcacacatacacatctcccaccactgacacaactaggctataagctcctccacatacacaaacaggaactcaatcaatgaacaaatcaggggaaattcttgcatgtatagaataaatttataaatagaaaacacttctaaatctaattgtgaaaaaccagactatttacagaggaaaaatgaaggaaataagaaaactcttcatctgcagtactgaaagctaaatgatgtcggaaatagcatctaaaagaccacttctctgtcagggccagagagacattttcagaaataaaagcacttgcagagtatctctatctttgagagaaacactggaagaagtccaaataaatgtaaaatgaaccacacaataaatcttgaataggaaaatattgtttagcaataattcttgcaaaagatatataattataaaaaaggacaatgtgacaatgtgataaagaggccactaaagagaaaattaataataccctatgataaaacattcctaataatctcaggaaaaaaacagaaaaaatggggtgcagaatggaaacaatgagcagaaatttcatcaatccaatgaaaatattatgtaaagaaaaggcagaaaataaaaagagctaaatagtaaacatcaaatggaaggcataaaatcagataaatcattatcacactaaactgagatgtaaaattctatcaacagagactataaattggatttgaaaaaagcaaaagtatctattgtaaacaaataggtaatctgacacagagacaaataggatacaaaataaagctctgggcaaagacatcatccaaatgcaatgaaagtaaaaacaagggtggcaatgtgagtatcaacgtggaattcgatgttaaaaagtgtttttcttggaattcgatgttaaaaagtgtttttcttttttctttttggttgaaaaaagggatcctataataataccacttaatacatgaaaaaggataaaaaatgcactaaccattaagtgtatgtatgcccatccctcagatgcacaaataaaattagcaaaaaagcacatataactgcaaaatgaactattaaaagtgatttttattgtatctcctccagaatatgaaacaagtagatcaaaattaggaaagataaagatttgaaaaataccaacaagcaagacttaattaaagagaattttggtccatacaacaaaatataatttttcttttatatctgttgaacaaagttcattgagtaacttggcttcaaggaaaatcttgataaattgttaaaagttgagacttgatagtctgcattttctgacaatacaataaaataaaaaacagctaaaacatactttaataatttgggaatgaataaactctcctaaataactaagattcaaagggaaacatcaaaatgaacttatgcatttcataaagatgtacttaaagaaactttacaaccctaaatgtatcccgcataaaacttaagaaaataagggaaagaacaacaaattacatcaaaaagtgggaaaaagagaaagtacctaaaaagaaaaagagaaaaaaattaatattaaaagagtagggagtattttattggacatttcaaaatgtccaatgaaacagataaacctttcagacgcttgattctttttaaatagagaaagaatgaatgatatataaatataataaccgtaatgataaaggagctactagtctggatatgaaagagaacaaaatggaaatggaaacatgcaattctatgtaatatattctttaaatctttagcaaaatatatcattataatgaaacagaaacgaaaatataaacagatcggtacgtataaaagagaggaaactaattaagatgtgcatcattcacactcctcagatccctccttagttcccatagtcatcctcccccacaaccccacagtccgccctcactccgccctcagatccaccaccagacagagacccccagtccgtcctcactccgcctgcagatccaccaccagagacccctcagtgccccctcactcctccctcagatccaccatcagagatcgctccgacttccactattccatccactgaccgaccccatcactgaccggaaggctcaggacagacatcagagattcttcttgctcagtccacagatgctgccatccctctactcacctgcccctcacccacgtcctctcaggacagtggtcatttgcctcgggaggtgactatagtcgcaagaaccagaacaggacccacttcctttttctcaatgcctcccaggcctagaggta

SEQ ID NO: 502 - DNA, 297570 bp, Homo sapiens
ttagtttgtaaaagtcttttattgtatccgtgccacacatagtgaaaaataacactcctaaaaaaagaatgctaccttttccacaacattttattttaaataaaacttcaagtactcttacgtaggtacaaaaaaaatctgatctatttgcctccaacaggccaccacaacacacagtagataaaacacagtggttacaaacgtcttttaaatttatttctgaggcaaggcaaatgggagggaaatgtttctatgaaaaaatactgtgtgcgtaggaaattgtcacaattttattccacatggatacaaatgattatactttaatttaggccctggtggcttaaaattatataacaaaatagaaaaatggaaaactaatatcccctacaccctgtttcaaaggcaggcactaccaagattaaggagacgccacagtgttggtagaggataattactgtacagactgtatagctatcattaccttcagacgaaaataaaatgctacaatcctctaaggcatgaacaataatgtctgcaaacaatatatacacataatacatatttaaaacaagacttaatataaacaagaatgaacagtatatacatgtcaattttttcactgttttgaaatacaatttaactacacaagtgatgcagcaacatatatatataaatgtacttgtaactctacagtaaagtttctttttggtgcttttatagcacatcagtgtaaacagtttaacttggctttgttttatattttaaaacattccttgtattttcaagatttaaagcaattttctagttcttccttttcacagaaaacgaagattctggatgtggtttaatcataaataattcataaaattaaatacattcactaaaaaataaactacaaagtaaaaaaatgaaaaatagatatttattgagagggaaaggagaaccatttcccacattagagctctggtgttgagtattcagtgcgatttgatatattttaattgctattgcactataacaccctttcctttgaaaattctttgggtgtgcttccctgttctacctaaattagctgataaatcacacaaaccaataaccgagggccttggttgttgtaggaatgaagcctttaaaaatggtatcattcttctgatactttttttttatacttaaggaaaaagaaagtcattatgtatgtgccttgcacgtttatgtaaatacagttcacattgctggtctcatttgtccttgtttagaaggaaaaaaataaagagattattataacttcagctcactttgaaagtatctgtccactttttttcaaaatacttcctcatattgtggccagctctgcctatatcagaatcatcttcattaaatgtttcacagttgtcaaaaacaagcctgacatctagagcaaaggtttcaaggtttggatacctgaaagaaaacaaataattagagattgcgttcatagagtggatttgttttgtaaacaaatgaagagttaataaagggtaaaaatgaaagaaaaatgattaggataactgcatttaaattgatataaaatacatgatatcctcttacaaatggaacatttaaacatttttgtatgttctggaacatactggatttaaagaacaggttaaatgaaaaaataggtttctccaaagatcaaaacatatttcaactggcattttccccataacccaactcctgtttgacctgtatcacacaattctgtcacaggacctatcccacttgactagtttattaagttctctgaccaaatgtatcacttgcagaatcctattatccatattaaaaaatgctcagctgcagtagaaattatgtcaatgctccccatgcaatgataaaaattacacttgtcctgtagcttctatatacaccccaagatatggtgctctgcgttgtcttccccatttcccatttctcttctcttcatatgtgctcttctgcccaagcaatagagtatgatgaacccaaacaagcaaaacaagcatatgctatctttctactagaggtaacattatgagggtctgtctttcaacaagaagcactgtggcttctgtgcttttctggcgggataagcccaattctctttctctgtagaaaaacagaaaagagaaaagaaaggtgaatgaatctgcataagcttattagtaagaagggaatggtcatttcaaaccaactcaagccagttcaatacattttaaaagatagcttttagaaatgcaaattttaagttaattctaacctatgacaatctgtatactaaaataatgtaaccattaaaaatatctcatgagtgtaaattagtacaaccactatggagaacagtttgtaggttcctcaaaaaaactaaaaacagagctaccatgtgatccagcaatcccacagctgagtatatacccaaaagaaaggacatcagtttatgaaagagatatttgcactcctatgtttggtgcagcactgttcacaatagccaaggtttggaagcaatctaagtgtccatcaacagacgaatggataaagaaaacatggtacttaaacacaatggcgcaccattcagccataaaaaaagaatgagattttgtcatttgaaacaacgtggatcaaactggaggtcattatattaagtgaaataagccaggcacagaaacacaaacatcacgtgttctcacttatttgtgggatctaaaaatcaaaacaattgagctcatggaaacagagtagaaggatggttaccagaggctgggaactgcagtggggaggtggggatagttaatgggtacaaaaaaatagaaggaatgaataagacctagtatgtgacagcacaacaaggagactatagtcaatcatagtttaattgtacactttaaaataagtaaaagagtagaagtggattatctgtaacacaaaggataaatgcttgaggtgatgaatacccaattttccatgatgtgattattatgcattgcatgcctgtatctcatgtagtccataaatatatacacctactgtgtacctgcaaaaattaaaataaaaattaaaaaaagagaaataccctatgaggcactgacgctgtgagatcttgtcaaagtggaattctatttctttggtgaaatatcttgtatgacctttcactcgcttcttctgtgcgataatgaaagaaatatttctctatgcgtaatgtgctcacagagttaagtcagcccttatgtaacctcatccattttcctaggaattacttgcttatttttactgaggttaagaaattcacataaaattaaccatattaaggtggacagttcagtggcatttaagtcacaacactgtattatcgtcacttctaaaacactgtcatcaccctgaaaggaaacatcatactcattaaacagttattccccattcctccctcttcccagtacctggcaaccaccaatcttctatctgtctctatggatttatctattccagatacttcatctaaatggaatcatacaatctgtgtgggaatgatttttacaaaatattttaaagttgatttgagaactacttctgcctttgttccttaccctaagaaaaggttaatgattaacattagggagagtggagtccaggagagaattctaggtgagattctaggtgaaaaaagtatacaactcatatgtgtgtccttcctttatgggatggggcagctaatggaactcagaaaaattcatgtaagtaggcccctccctctattctaaaaatttctagtttaaaaatttgaaatatggtttgtgagttttggttccaactcattaatttgggtttaatcaaacaactcaaagtggagagttcgaggagcttgaatccactgaaattttgcttcccacacacctggcatcacaaacaggaatacacagactgtttccttctctctttctcttcccctgtgacttcctccattcactgggactcatttttcaaaggagctctgattttgtagcttttttttttttttttgagacaatctcactctgttgcccaggctggagtgcagtggcgaggtaactcactgcaacctgcacctccagtttcaagtgattcttgtgcctcatccctgagtagctgggactacaggcatacaccaccatgcccagctaatttttgtacttttagtagagatgagatttcaccatattggccaggctggtcttgaactcctgactttaagtgatccatctgcctccacctcccaaagtgctgggattacaggcgtgagccaccttgcctggcccatatgattttgtagcatttttttgttataaatatttctaagcctatttgttttaggaattttgaggtttacgttaatcttttatccaggaattggaagatcatggaagttaaaatcaagagttaatttaaatactagtaaagtcttcatgtgtaattctttttcttggccatgttagttataaatttcattgtgccatctacctagacaactattttgatagaacaaacaaaagaggctgggtgaggtggttcacgcctgtaatcccagcactttaggaggtggaggtgggcggatcacctgaggtcaggagttcgagaccagcctggctaacatggtgaaaccctgtttatactaaaaatacaaaaaattagccaggcatggtggcgtgcacctgtaatcccagctacttgggaggctgaggcaggagaatcacttgaacccgggaggcagagattgcagtgagccgagatgcaccactgcactccagcttgggcaacaaaagtgaaactctctcaaaaaaaaaaaaaaagaacaaacaaaagaactagtccatatctaggtaacagtgtttgcatattggaaccaatcagtaccaatcaatcatttaaacgcttccttaacttaggcaggtcccttctgtaattaaaaaataataaaacaaaacagacataaacctttggacggctgttatttcatcctccaaagaaataaatttgtcatttggtcaatctagtaaatcagttgatatatgtgagggatgctgatcattataagttctatttaactcttctaaattgaatataaatcatagagaacagttattttcaccaaaagaatgtataggaagaactaaataatatactggataataacaatgtaattaaaatatatattgtatgagtatcaggaaagcctcccaaagtaagtaactttattcttggaataggattgcaaagagaatatggtagagaaaagcaaataagctttctctcccgcatttaataaatggaattttggtattctccaataactcacattaaagctcttaatatgtaaagcttccaaagatcttctatttctacattgtgataatctaacaatatttgagtcaatttttgttaaatccatatgacgtgtggttgatactccatggatgcaaaatacaaattccggcttatatgttacttactttgggaggctctcctgatacttttccttaccttcagcttgggtttgtggtgctctttcaatgtcaaaagcaggtttattacacgggtttttaatttcttaaataattttagttggtttctcttctatactattctactctaaccaaatacacacacacacacacacacacacacacacacacacacacacacacacacacacacacacacacctgcctcaaaggcagggcctatatcttgctgttaattaaaatatctttggctcactaaaaatatgcctagcatatatcaggtattcaataaatatttagtgaactgaaatgatttacttactgtccactacttagtttctctctaattgtggaaaaatccataggcttcttaataactttcttataaccaggaacaagtttcaagtttacaggaagtagaaaaggccatgcatcctcatgagtttccatttcagtcagaatcatactaaagaaaataatgtttgaaatcagtatccatactttacaactgtcttattttttaattaaaaaagctttcagttattatatatatattatatatatatatatattatatatatatatatattatatatatatatattatatatatatatatatatatattttatatatatatatatatatatatatatatatgagatagggtcttgctctatcgcccagactggagcacagtggcaccatctcggctcactacaacccctgcctcccgggttcaagtgattctcctgcctcagcccctcgagtagctgggattatgggtgcacgccactatacccagctaatttttgtatttttagtagagacagggtttcaccatgttggccaggctggtcttgaactcctgacctcaggtgacccacctgtcttgacctctcaaagtgctgggatttcaggtgtgagccgctgtgccaggcccaattataatctttcaaataaaaactcaatgcaaattaacattaaaagaagataaaggaatacatttactatacttttacttatatattttcttaacatttatgctttacatttttttatttacataaattatcagaaagaaagctttaatatggtaaaaggtttctaaacaaataaaatggggcattataaatatacagtgcatgaaaacggaaataatacctgcaaagagctaggtccttggagtcatctcttttaggtttcttaactgaagtaaaactttcttgttttgacaagttaatagaagtgttttcctccatttttcttttcttgaggtctttgtttcctctttttagtgaactacttgtagatgcagagtcttcatcttcagtatctcctgttaaagttaccttcttgcctttctttgactcattagtcttttttcctttgacatgaagttttttgatttttagagtttgaccacttgcctttaatttaaaaaaaaagtaaatgaggtgtaagaaagtgactgtctacagacctattattttaaattatgaaagtctgacaggacaaataagtaaaaagaataactctgatctagaatgttgataactattattcttaagaaagatctgtgtattttttcctctcataatataaggataaaatctaataaaacatgaaaagtctattcatcttaagaattcttaaaacttgaagatgctaatctcatggtaattcatctacagaaggtgtctgtagtattctttcagtctaggtcactacttgaatgagtttaaagatacaaaagaattctcttttggagcacaacagaattaggaacaaagatgaatataaatgaaaatatagagattgttaataagaaagttgaagaggtaataaaaagccaggccaaaaaatgaaaaagagctaaggaagtgtcaaatagagaagtccaagtgatcaaatctactagaaattgatttgattttttttcctggataaaagataacaggtatttgcaataagaagagagttccacaaacttgtggttcccaggtgtgaacaaagcagtggtgaaagatggggcaaaaagatgtctgtttttgagaaaaacaacatagaaagaaatgacataaaggacattatacttggaatcgaaggatatgaattccagctatggctctgctactaactttaagcaaaaatatttgtgaggccctgttttctcacttaaaaaataaggatgacaagccacatacttgctaaagtcattctagctctagaattacatgcaaaaaagaactctcaacatggtcttatgcaatataactacaaattgcaggcagcacactgatgcaacaagaagggtgccccaccctgtattcatagagaaaaaaaatctgccttttgagagttaaatgttataataaatataatagatcatgaaagaaagatatgtaaacttctggcaacgtatggcttttatttttattttccaaatatgtggtacacaccaaacacttttagaaaactactattcccttaaccagattgttaagaaatcctagactgcaaagtcacataatcagtgtagcaataatttaaagttggctgcaatctttttttttttttttgaggcagtctcgctctgttgcccaggctgggagtgcagtggtacaatcatggcttactgcagcctcaacctcctgggctcaagacatcctcccatatcagccacccgagtagctggggctacgagtgtgagccaccatgcctggctaataaagttggttgtattcttaaaattggctgaaaaacagtcctttggagtatttcatagcattgtctttgaggatttcatgacccctgccagtaccttacttaaaaatgctcttaagcagttaaaattatttgtttctttattggcaggttaaagtatagttaaggagatattttaattgactaaataaggcaaaccataaatccaacactttcaccatatgatatcaaagaatcacaacccctgtcactaactgaaataattaatatgttttattcagtctcttctccatttagttatttatattcattaaaatctgattattttgggtttttatattacactgagcttttactctgaatctctaaaatcattaaaaaggagaacttaatataatgaagaaaaagtccatttaatgacaagttagattaaataactgtgttacttaaaacagagctggaattatgaatagtgggccaaaacatttagtttctatttgaactaaaatattacttgggataattttctaacaaattaatattcacaataagaaaatatgaaattgggccaggcgcggtaactcacgcctgtaatcccagcgctttgggaggcccaatgggggcggatcgcctgaggtcaggagtttgagaccagcttggccaacatggtgaaaccccgtctctaccaaaaatacaaaaattggctgggtgtggtggtgcacacctgtaatctcagctacttaggaggttgaggcacaagaatcacttgaacctaggaggtggaggttgcagtgagctgagatcacaccactgcactccagcttgggtgatggaatgagactcagcctcaaaacgaaaaaaaaaaaaaaaaaaaaagaaagtatgaaattgaaatcacagaatcaaaaaacttgtgattttttaaagacaaaaaatgatgtgtgtcagctgatgatctcattagatagtgcacctacacatactttaaaagcaaacttttatcaagttactctgttacctgattactttgctcttgggcagggcattcccccaacccccatcaccttttcttggctagagtacaaattcaaagaggaacttagtgggtcttaagcaaaacttatcagatttcatgaacaatggtacatatctttctagtttatatattgatagaagtcacaaactggtggctcaccggctccaaacaggccacagaatgtatttggttcatataatgcttgtaaaaattctgaatttgtttccaatatttaatatttgggaggacataaaaatccatagtcttgacttcccttgaaatattagtgggttctggaacatggggcccacattcctacatggcaacaattgggtggagttgagctttgactattaaatttaaatagggccatgactcccctgtttgccacagtgcccatgaggggtccaatgaactctttcatgtcatttacttggcttttgtaggcactgaagtttgaaatgtctaatatgtgagtttgtgtgtgtatgtgtgtgtgtatctaagagtgtatattcatataagtggccctccatatctgcaggttctacatctgtggattcaaccagctgcagatggaaaatataaaacaaaggccgggcacagtggctcatgcctgtaatcccagcactttgggaggccgaggcaggcagataacttgaggttaggagttcgagaccagcttggccaacatggcaaaaccccatctctactaaaaatataaaagttaaccaggcattgtggagcacacctgtaatctcagctattcaggaggctgaggcaggagaatcgcttgaacacgggaggtggaggttgcagcagtgagccaagatcgtgccactgcactccagcctgggcaacagagtgagactctgtcttaataggaaaaaaaaaaaaaaaaagaaaatataaagcaaaaaatccaaccccctcataacaaaacaacaattaaaaaataataaataaaaaacaatatagtctaacaactatttgcatagcatttattgggtatttattgcatagttttattgggtattataaataatctagagatgacttaaagtatacaggaggatgtgtgtaggttatatgcaaataatattccattttatataaggaacctgagcatctgtgactctggtatccatggtggatcctggagctaatcccttgcagatttgcagatactggggtatagctatgttgtatatatatgcacacacacacaaacacatacacatcttttcgattctgtgatcctgtgatcacatatatacatacatacacacacacatacacgcagagtaaaaacagttaatcaggataatgtatgcagaaaaagccacttgagagcaaggtgtatgtatagtataaatatttttaaataactatgaattaaattgaaagatactttaaaaaccttaacccttcattatatatcaaaatcaatgtttagagttttactgttgtaagaaatatctagttcactacatttaaaaaacaaaaaaagcagaagcttagaaagctgtactcacatagaagggcttgaatgagattacagatcttatgtctccaagtttactgcttgaatggtagatagctaggatactaatttaagaaaatttattgaaaacaaacgtccaatgacctaccaggtgatactcccaagaccaaaaacactaatctgttagtaattcatagagtattagagaaactttctataacttaagttatgaagttataagataattttatgtacatcagtgaagactgctgttaagttatatttaactatgtatgacaaaaatgatcaatgagaataatcaaaataatcaaaaaatgactattagtgaatatgatgccatgtaagaccacttgctatcttgtgaaatatagtctaaaatataaaatactaaaataaacatttcacagaactataaagttataaaaactttcacatttatgaccttatttgatcttcacaaattcccacaaagcagatactatcccattttacaaatgataacctcgaggcaaaaaaagcactcccatgtttacagatcaggaaggtggggagaaatcgatgaagatttgagaagaagcaaagactggaaagaaaaccaggagagtatggtatcttagaagtcaagtgaaaatcaatgtttcaaagaggagagagcgttcagttctatcaaatgtaataggtcagatgacataggcactgatcactggagtgagaaatctgaatgctgtttgtggtcacaataagagcacttttggagaagctgtggaggtgaaaatctatagtgagttcaagagtgaatcagggccaagtgtggtgtctcacacctgtaatcccagacttcggaggctgtagtgcgaggatcagctgagcccaggagtttgagaccagcctgggcacatagcgagaacccatctctacaaaattaaaaaaaaaaagccaggcatagtggcacaggcctgtagtccctgctgcttgggaggctgaggtgagaggataacttgaacctgggggactcaagactgcaataaactgtgatagtgtcactgcattccagccaaggcaacagatcaagattctgtcttaaaaaacaaagagtgaaccagaggagagatattagatagaaccagaacaaaaaattttccaagtgtttttctgtaaatggaaggaaaaaatggaggaactggatcaagggagaagtgaggacagaagagggtttttgtttagttttcttaagatgggagagatagcagcacatcagtaggctaaagagaggaacccagtggagaaggagaaattggtgatgcaggagaagggagaactgctggaataatattcccaaggaggtaagaatggatgggatctgaggcacaagtgggaaaatttgcttagttaggagttcatggcaacagcagagaaggtaaggtatgtgagcccggatgcagaaggacagcagatgtgctggcaagatgtgatattttcttccgatgacttccattttctcagttgaatgacaataagttgagaatgaagatggaggaggcagagctagagataaattattgacatcattaaaggcctctaacaccttatttatttatttattaatttagagatggagtctcactctgtcactcaggctggagtgcagtggcatgatctgggttcactgcaacctccacctctgaggttcaagcggttctcctgcctgagccccccaaatagttgggactacaggcatgtgccaccactaatttttgcctggctaaaattttgtatttttagtagagatggggttttgccatgttggccaggctggtcttgatctcctggcctcaagtgatctgctcgcctcggcctcccaaagtgcttgaattacaggtgtgagccaacatacccaggccttaaagccttgaatttaaaggctgagtattacacagctatattcagatacaaaggtataggtgctagagaaatcagagaattgtattaaccagaataacggttttaccaagggcaggggcaggcaaaggacctaatggtggaagcaatgattgggataatgggataatgacacataagacagaataggaggaaagagaggacatgaagtgggagagcaacagtgaaaagtcttaagacaaaccgaaagtcctggtgagatccaaggattgttggagttgaagtgctacagggagtgaactggaagggaagaaaggaggtggacagatggatgtttgaagtgagtttatggagaggcggtagttaaaagttaggttaagagattgttaacaattagcttactgttaataattaggttaagagattaaacatgggagaaagtaactgaggtagggaatacctagagtctgccttcaaaaataaacaccataaaattctgcattttgatctagtaattaaaaagttgtttggagccaggtgcagtggcttgcatttgtaattccagtgacttggcaggctgaggtaggaagattgcttgaggccagggatgagaccactgcaggcaacatagcaagaccctatctctctctcaaaaaaaaaaaaaattagctgggtgcagtgcacacctgtagtctcagctactcaagagattgaggccagaggatagcttgagcccaggagttttaggctgtagtgggctatgatcataccactgcactccagcctgggcaactgagaccatgtattaaaaaaataataaaaagataaaataaaatgaaaagtttagttttagattggtcttaccttagcaatgcaagctggacaaaaccagtctccatctgggattgttgtaatcttgggtctatggcagtaggtatgacagcctttgtcacagccatcacaaagaagaagcagttcttcattatctccctttcgacagatttggcagtactataatacatgaaaaatcatttaaaattaacgctctgccatgaataatagttattgggatgttaaacacaccataattcctaatttatattagtaatgaacattccgcttgcttacaaatatacagtagccatacacatctatgtatctttcgttacacagatatggaccacatgacgggtgagcagttctattggggtaaatgcacatttcaagtacactgcaaagaacaaagctagaggcagaatgccttgcacacacttcagaagcatgtacacattaacatatgaaataattaacatgacattagagcacataaagcaatgaatagctttaatacatgatgttttatttgtttaatgtgcttcatcttttgcttatcttagcatcctcatgatatcctgagaaagaaataagagttagagtattttttaaaatcaaaattagaaaacttgtattagtatcataattacgtataataaaaagataaccctagatttttgactaattcatctatatattgtgatagattggaaaatgtgttcaaaccaggaaacgttgaaaatcaacccaaatcaaacatgtgtcacaagtgcagaaaatggatcctacaaaatggtttctaaggaaaaaagatacaatacatgtaagaagttaagaggtcattatttatttttttagaattaaaaataaaactagttgttttctactgaaaattttctaatataattaaagactttaaatctgcaaaaagaagactttttccatgtacacatattctgtacggtaagttttacaaaggaaagaagaaaagttagacaagtaaaaacttccaagatggctttaaaagacagtaagcattaacactgttttttgacatctagttcatactccagtcacaaaaaaaaatgtcctgcagtccatatttttaaaaatgaaaacatgtaaccagaaatcatttaaactactttaaagttaggtatttatacgctcttaaaaacaaaatagcttaactgttccaacttactttaattttcaatgcaacattatatcttagtctgggaaagtctaaaatggtcttcttataacttagtatgtataccaatgacagttgtagaatcttatcaaaacagcagacacactattcaagttaacaaatgtttatcaaatgtatatactatatatttcatattaacattggcgcggttaccaagggcaaaagcagcagtttaacattccaataatcagtatctattttttgacctttcctaacatcaccatcactgaataccttaagatggtgttgtttctccatatttgagttacatcgttaaaacttctattgtaaaagtattcactgagaaataacaattgcaaggttatatgtatatccctgtaacaacacaatttaaaaatcagattcatgaacataagtaaatactcattgttttctctactaggcaactataaatgctacaagatctgtcttacatctcacacttaggatttaaaaataaaattatttcctgatacttttaaagaaagggtgacagatatcaaactcataacaattttgaaaaattatagtaatagctcacaatatgttacagtaaatatattattatttggttttaattcctctgctactacagtaaaaaatagtggatgctgcctactgtttaacaatataaagcatactgtgggtagagaattatctggaggcaaattatgacaactccctctttttcttgataaccttggtctttgtccaaaagggtatttctaaagatatcgagcactttaatattttgtcaggacttactatgaggattactataggcactgttatgtctctaaaggttataaggtgcttcttaatctttgaatatgaaacactgccttcttttcaaggtagtttcatagcaagaaatgtattattaagcattttaaaaaggaaatgaagattgtgagagatggagttatatgattaataagagtagatgaagaacaagagaaaggttaatgaatttgcaaaaatggaaataaagctatagattgcagaatttaaatatatcaatataaaggcaggttttgatacaagttttaggtttatgtgtgtaagtttataataaaactgaacacatcatgatgactgctttggtgtagatgagaaaaatataaatacaaatttcattttgatctaggacttaatctttttttttcagttttatttacagacaaggtctcattatgttgcccaggctatagtgcagtggctgttctcaagtgtaatcacagcacactacagcctcgaactcttgggctcaaatgatcctgccttggcctctggagtagctgggactatcagcatgcaccaccataactggcaagaaatcagtctcagtttctctctcttttttaaaaaaatcattattgcctagatctcaccaaatatatttgtctaaggtgacattcaagctggttttaataataatttttagaaggaaaaaatatttgtacctggtaaaaacactattaaatgaatcaaacagtgccttaaaatttatagtaaattctgggccaggtgcggtggctcatgcttgtaatcccagcactttgggaggccaaggcaggcggatcatttgagttcaggagttcgagaccagcctggccaacatggtgaaacactgtctttactgaaaatacaaaatttagctgggcatggtggtgcacgcctgtaatcccagctactcgggaggctgagggcaggagaactgcttgaacccaggagattgaggttgtagtgagctgagattctgctactgcactccagcctgggcaacagagactctgtctcaaaaaaaaaaaaaaaaaaaattatagtaaattccaatctgaattgagaaagaccctgtattccagcacattatgaaactgcagattcatagatgttttaggaagcagtgaaaaaccatagaagaaacgtaatttatttgtgtggaattaataaggccttgagtagtctaagcataaaggtaaagacgaaagaaagaactctaagttatttaagaatcaattcttttcttcagggaaacaaccattttaagtaaaggaatttcacctttaaccattcatgaaaagaatctcaaatgtttaaattttaaagctagtctgtaattcaaagtaaatggtagccaggcacagtggctcacgcctgtaatcctagcactttgggaggctgaggtgggcggatcacctgaggtcaagagtttgagactggctttgccaacatagtgaaaccccatctcttctaaaaatacaaaaattagccgggtatggtggtgggtgcctgtaatcccagttactcaggaggctgatgcaggagaatcccctgaacccaggaggcagaggttgcagtgagccaagattgtgccactgcactccagcctgggtgagcgagactctgtctcaaaaaacaaacaaaaaagcaaatgttaaagtaattcataaaagactacatataatagataattctatatatgataatataaaagaggcaagagggacacttgtacatgatttaaagtaaatatttctctggaaaacatgaattatagctctgtattttgaacacacaccattttggtgcctgatacaaaatagagatttttgtgataaactaaatgataaactaattggggttgtagaaagaaggtggaaaaccaattttaattagtagaagacagactaaaggatctactgttcatgtcaaccacatctgatgccaaatacatgatataagcacataaactaagagttctctgcttatcttgtatttacttatctaagtgcttcttagaattaaaaaatgaaaactgatagaaaaagacattttagctacgcagtaatatagcaggtaatgttagcaatggaactgtttactacagtgaaacagccttcaagatttagattaataactattgtgctgatggaatgtgggagacaacttcagttagaggtataaacgatattcaaaggaggcagaagcaagattttaaaaaataaaagataacacatttgaaaggttccttcagtaaggaggaaagtatcaaaaatcttttagaattagaaaaactctcaagtatagcatacattattatgacaataggtaatgtataattaagaaagatctggaggttggaagaaacaggacaaagtaaattagttataatatttcttaaataaaaacacttacaactttcataattgatttttcccatgctattgatttctgtaattgctgaatgcacagagctacctgtgcagcactgcgagcttctgataatgcccttctccataccctgagccctggagcaatatcctcttcaattctgcattgaaatatagaaaaattaagtaggtcatgtccacacttacgattacggaatgtgaaacaatcatcacactgaaagccaagcaatgacaaaaacatgtaacagccaataagtataaggtttaagcaactaaatttgatgtagtgcacagactgtggctacgtgcctcaaagcttagtcacaaccaggtagatgtaagatcactttgcaggattatcaacgcacataacaaaaaaaaagtttttacaaagcaccatgcaaatagcatgatccgtatggatcacagacatacaagaagatacatagataacaggcaatagaaaataggctccaattagcaaagaagcacaataatttttcaagttaatctcaataacctacccgtcaccatcaccactaacggatggtgcaggagcagggacagtaactgtgcccacattatccagtttgatctgaatggtggtacttaaggggctcttcagataccttctttcaatgttccgctccaaatcagccagcctggttacagctatatctagggggttgtcactcttccgttctagtgcatgtgcactgctttcgtcttcgccagtaaattctccatcatgctccttgcacaatttagtaaatgatttatgttcaaaatataccaagtcctccctttctgatgcaggctctggacacatccaaccctatatatcaagagaatagtgttattatggtttcctcttaaaatgctaggtgggtgaattacctttacttaaaatacagcattggatactggcagatctcaaggattgttactaaaagattttaccttgtgtttcctaaaactaggtggaaataagaagaaaaaaattaaaagaaatagttgtaagaaaagtttgaaaaataaaatttataaacttttgatattataaaaggtataagaacaatcagcaaaatattttgaaggattttagaccaaaatgcttatcagtttcatgggatcacttaaatggaaatctctgggtagcctctgagcctttgctcttcctttctgttttcattccttccattattcttctgtacaggtccttctgtgctcaccatttttcctttgactgcaggggcttcaaatatgctattacctttatctgtattgcttttcttttgctcctcttcacctagttaacgccactcatttcataggtctcatgttaagattcactttaacatgaaaggatcctgataggaatcctttcctgacctctttcaggagctaagtccctctctgacaggttctcataggaccatgctccttagccttgtcataaatgtaattttatagtagtgtaattattcgatgaatatttttctacttctaaattccatgagagcagggactatgtctgcttttactcatttatctccagtacagtgcaggcaaataatgggcactcaatacatgtatgttgactgaacaatcaatgatcctgtagctcaaaatccttcaaagatttcctattctttaggaaatgttcaccatggcattgaagtacctcaatctatcccttttcatgttcccattcacacatcttatgttgcagtcaaattctataatttgctcttccacaaacatgagataagctttccaatcctcgtgctctgctcatgctgttcccacttcctgggatgatattgcctggtctccaattgtccaaaccatactcattttcttaagttccatttcaacttctaaatgaaatcttccatatctctgccagaagtcagtattcttcttctaaattcatacattactctgttctcaacaatcagctactagattctgcatatatgtatatgtctgatctccctattatatgacaagctttcttatggtaggaacgacactttatccaattttttggtgtccactgcctgagatgcaataggtatttaataaatgcatattaaatgaaaaatggaataaacttaaacatctctttagatataattattttatcttatatactaggataaattcttcccctttaactcagtagaatatttatatttagaaaggaaggatggactctaaaatggtgtcacagatacaagctggcttcagttcctgcctccaatgccctccccgtccctgccgccaaccactcagaaaacccaaaataaatatacggcactgagacgatcaccagcaacatcccaaaattcaaacatgaggatgagatagttcctgtggcaagagagaagtgaaaaaactctgagcagatggtaagagaactggacttccatatccacgatgcttctctaccctcattctgccaggaaccaagcacacagaaaacttccccctaactcacagtttctacactgaaaaaagtgagatcaagatagacaaccaacttatccactatgaaaaacagtgtgaaagttcctcaaaaatctaaaaatagaactaccatacgatctagcaattccattagtgggtatacatagaaaagaaagaaaatcaatatatggaagagatatttgtactcctatatttactgcagcaatattcacaatagctaaaatatggaatcaacctaaatgcccatcaacagatgaatggataaagaaaatgcagtatatttataggatggaatattattcagtcataaagaagaatgaaatcctgttatttgcagcaaaatggatggactggaggacattatcctgggtgaaataagccagatacagaaagacaaattattatatattctcactcatatgtgagaactaaaaaagctactctactctagaatgtagagagtagattggtggttaccagaggctgagaagggtagggagagagtgagagtaagagaaattgactaatgggtacaaatatatggtttgacagaagaaataggagaatacataaagacaattagacaaaatctggaaaacaattcatgatttgaatgagaaaatcaacagagacagatataaaaaagaaccaaacagaagttctagagctaaataattcaatgaataaagtaaaaaatacaagactagatcaaaaagacagactagaccaaggggaagaaagaatttctgaagacaggtcgtttgaagtaacataggcagaccaaggggtggggggaaagaaagaaaggaaaacaaagaaaaaggaaaaaaagaaggaaaaagcctataggatttatgggacaccattaagcaaacaaatattcctgtgggtgttacagaaggtgaagagaagggaaaggtgaggaaaaaaaatttaatgaaataatagtagaaaactttccacatcctgggagaaagaggaaaattcaggtacaggaagtttgaagaatcccaagaaattcaacccaaacaggtcctctttgaggcatattatagtcaccctgtaagaagtcaaaagacaaagaattctgaaagcattaacagtgtcaagtcacatataaggaaatctccattagactaacattggatttctcagcagaaaccttgtaggccaggagagaatgggatgatatattcaaagtagtgagagaaaaaaaaaaccctaccagccaagaaagccttcagaaatgaaggagaaaaagaatcttttacagactgagggaaactgaaggaattcatcaccactaggctaaacatgcaagaaatgctcaaggactcctatatctgaaagtaaaaagatgataaccaccatcacgaaaatatgaaactataaaactcactgggaaagctaatacacaaaggagaaaggaaattattacacacataattttaaaaagcctgatgataaactgtatccttatggaaaaacacccagccacaaaaataaataataatcaaggaagtaaggaacaaaggattatacaaaacaagagaaaagcaatcaataaaatgacaggagtaagcactcacctataaatagtaatcttgaatgtaaatgaattaaatttcccatttaaaagacatagactggctggattaaaaaaacaaggcccaactatatgctgcctataagaaactcccctcacctgtaaagacatatgtagactgaaagtgaatggatggatagaaatagcccatgcaaatgaaaaccaaaagtgaagaggaatagttatacttatgtcagataaaaaaaacaaacaaacaaacttcaagttaaaagctgtaaaaagagacaaagaaggacaattatataaataaagggatcaattcaacaagagaatacaataattgtaaatatatatgcactcaataacagagcactcaatacataaagcaaatattattagatccaaatgtagaggtagatcctaatatgataatggctggggatttcaacatcccactgtcagcattggacagattttctagacagaaaatcaacaaagtaacatcaaatttaatctgcaccatagaccaaatggacacgtacagaacatttcatccaccagctgcagaatacacattattttcatcagcacatggaacatatgccaggactgaccatatgttaggactcaaatctcaaaaaattttaaaaatttgaaatcatatcaagtatcttctctgactacatggaaataaactataaatcagtaacaagaggaacatttaaaaccatacaaatacatgaaatgtaaacaacagggtcctgaacaaccactgggtaaaagaagaaattaagaatgaaatttaaaaattccttgaaataaatgaaaacagaaacacaacattccaaaatgtatgggacacagcaaaggcagtattaagaagcaagtttatagcaataaatgcctacatcaataaagtagaaatatttcaagtaaacaatctagcaatgcccttcaagtaactggaaatgcaagaacaaatcaaaccccaaattagtagaaggaaagaaacaataaagatcagagcagaaataaaccaaattgagacaaaaatacaaaagatcaacaaaacaaaaagttacttttcctaacaataaaatacctaggaatgcagccaaccagggaggtgaaagatctctacatggaaattgcatcacactgctcaaagaaatcaaagatgatacagatggaaaaaatcccatggtcatagataggaagactaaatatcattaaaatggccatactgcccaaagcaatttacagattcaatgctattcctataaaactaccaatgaaattcttctttgaactagaaaaaactattgaaaagttcatatagaaccaaaagagagcccaaatagccaaggcaacttcacttcttgggctcaagccattctcccacctcagcctcccaagtagctgggactataggcacgtgtcactacgcccacctaatttttgtattttttgtagagatggggttttgccatgttccccaggctggtctcaaactcctgagctcaagtgatcctctcaccttggcctcccaaagttctgggattacaggcatgagccactgtgtccggcctcagcagcattttgatacatgaacaatgaattcactaaaaaagaaatcaagaaggcaatcccatttacaatagctaccaaacaaacaagcaaaatcaaaaacaaaaatccaattctaggagtaaatttaaccaaagaagtgaaagacctctacaaggaaaactataaaacactgattaaaaaaaactgaagaggatgagaggatacaatcatgcttatggatcagaagaatcaatattgttaaaatgataatactacccaatgcgatctacagattcaacacaatccctatcaaaacactaatgatattcttcacagaaataaagaaaaaatattaaactttgtgtggaattacaaaagactgaatagctaaagcaatcctgagtaacaagaacaaagctggaggtatcagactactaagacttcaaaataaactacaaagctgtagtaatcagaacagcatggtacaggcataaaaactgacacataaaccaatgggatagaatagaaaacccagaaattaatccacacctctacaatcaactgctttttaacaaagctgccaagaatgctcattgtgaaaagaatagtctcttcaataaatggtgccaggaaaactggatatccatatgcagaggaattaaactagacccccacctcttatcctatacaaaaataactcaaaatagatgaaagacttaatgtaagaccccaaatgataaaactacagaagaaacaggacactggtctgggaaaatattttatatataaaacttcaaaagcacaggtaacagaagcaaaaataaacaaatgcaactacatcaaatgaaaaaacttctgtacagcaaaagaaaaagtcaacagagtgaaaagaaaatcctcaaaatgggctaaaatatttgcaaataatacatctgaaaggagattaataccaggatatacaaggaactcaaacatctcaacagcaaaaaaccaaacaatctgattaaaaatgggcaaataatctgaacagacatttctcaaaagaagacatatacatggccaacaaatatatgaaaaaatgctgaacatcaccactcatcagagaaatgcaaatcaaagccacaatgagatattatctcaccccagttagaatggctattatcaaaaagaaaaaaaacggccgggcgccgtggctcacatctgtaatcccagcactttgggaggctgaggcgggcagatcacaaggtcaggagatcaagaccatcctggctaacatgatgaaatcccatctctactaaaaatacaaaaaattagctgggtgtggtggtgggcgcctgtagtctcagctactcgggagactgaggcagcagaatggcgggaacccgggaggtggagcttgcagtgagccaagatcacgccactgcactgcagagcctgggcgacagaacaagactccatctcaaaaaaaaaaaaaaaaaagaaaaaaaaaaaaatgagatgctggtaagaatgcatagaaaagggaactcttacatactgttggtgggaatgtaaactagtacagccactatgaagaacagtatgtaggttcctcaagaaactacaaatagagctatcatatgatccagcaatcctactactgggaatttatccaaaggaaaagaaaattgtcgtattgaaaagacatctggccgggtgtggtggctcatgcctgtaatcccagcactttgggaggctgaggcgggtggatcacctgaggtcaggagttcaagaccagcctcaacatggagaaaccccgtctctactaaaaatacaaaattagccaggcgtggtggtgcatgcctgtaatcccagctactcaggaggctgaggcaggagagttgcttgaacctgggaggtggaggctgcggtgagctgagatggcgccattgaactccagcccgggcaacaagagtgaaactccgtctcaaaaaaaaaaaaagaaaagaaaagacatctgcatcccgatgtttactgcggcactatacacaatagccaaaatacagaatgaatccaggtattcaacaacagataaatggataaagaaaatgtggcatgtatacacaacagaatgctatacaaccataaaaagaacgaaatatcctgtcattagaggcaacatggatggaactggaggacattactttaagtgaagtaagccaggcacacaaagttaaacactgcatgttctcattcatgtggaagcttgaaaaaaaactgatctcatagaagtaaaaagtagaccagaggatatactataggctgggaaaagtgggggcagggagggataaagagagatttgttaaagaatacaaaattactggctgggcgcagtggctcacacctgtaatcccagcactttcggaggccgaggtgggcagatgatctgaggtcgggagtttgagaccagcctgaccaacatggagaaaccctgtctctactaaaaatacagaaattagctgggcttggtggggcatgcctgtaatcccagctactcaggaaggctgaggcaggagaatcgcttgaacctgggaggtggaggttgctgtgagctgagatcacgccactatactcaagcctgggcaacaaaagtgaaacttggtctcaaaaaaaaaaaaagaatacaaaattattggtaggtaggagaaataagttctcgtgctctataccactgtacgatgactatagttaataatatatattgtttcaagtagctaaaggaggatattattcttaacagaaaaaaaatggtaaatgtttgagataatgaatatgctaattactctgatctgatcactatacattaaatgtaccaaaacatcaccatgtactccatgatactgtacattatcatttatgattttaaaacaatttatgaagcaaattctacttatcttagctactgataacacagccaagaacatttaagcagtcagcaatgtgataaaggtcaaaggaccaaaatctgagtatgtcaccaggaaaatgtttcaggcccacactcggactttacacatattttttaaaagcctgatgatacactttcccaaccaacagtcaactagaattggcaaatgagttgggaaaaagctggaggaaaatagggcttatggaaccaatcaaatttaaaccagcaagcagtatcaactgacaaactgagaggacaaccacagactatagaaagtagatgtagcagttttaaaaccaaagcacactaggatcatttaggttaggtgcaaaacctcttctcatttcctgagggaattattgtctgataattgatcttcatactgatgattctgtgccaccatgataagttaaatcaggctttttattttcaatttaagaaggcaatgaaatgtgtaacataagcgatccaaaaacacattaaaaaattctagcactaaatggaataattttcatttctccagaaaataaaatagtgtgaaagggttcatctgttgaagatgccagaaagatgacaatacacgaggcacttttatactgtattatagaacctggaggaggagacatagtttactagcacaatagtttcaataataaatttttgcttcccaacgttggtaattacgtttgtcacaagaaagggatattttattagctctggaaaactacattttttgagatcctcaaaagtgtccaaatgcctatgttaaactaattatgaagcaaaatctcaattattaaataggatagcattatgccataaatttctcattctgaataaagcaaggcatttcaaatcaaattacatggagattaaggtttctaaacctttagtaccttagcagattctagccaggcacagtggctcatgcctgtaatcccagtattttgggaggccaaagtgggtggatcacttgaggtcaggagtttgagaccagcctggccaacgtggcaaaaccccatctctactaaaaatacaaaaattagtggggcatcacggcatgtactttggaagcctgaggcaggagaatcacttgaacctggaagtggaggttgcagtaagccaagatcacaccaccgtactccagcctgggtgacagcgtgagactccatctcaaaaacaaaaaacaaaaaaacaaaaaacccccaaaccaaaacagaaccttagcaggttctaaacctttcatgcttttaaggagacctttatacccctctttacaaaaccaaaaattcttgcacaagggtaaagctttccttttgtttgtccactggaaaccagttctgatcattacctgtaacatgataatacccaggagatagatgagggaatgaatgaataaatcagtaaataaaaactttatatatatatatgtagggtatgtgtgcatgtgtcagtatatcataatggtctataacatatatttggatatatctatattggtctccaaattaaactatatagtataaaagtctgacatataacaaggcttgtatgtaaggaagttcatggccctatatgaaacactacaataggagtttgataatatttgtactagatcatcacattcatctcagtgaaactggaattctgctggtagtaaagaactgcgcatcggaaataatacctctgaataccattaaggaggtagcaagattactaaaaagaacatgggctctggagtcagacttggtttaaatgcacatttaggcacttactatatgaccattggcacattacttactctgagcctggttccttaacagatggggcaaattaatccaggattgttttcagaattaaatgagacaaaataaaaacatttagcacattaactagcatatattaggcaagtaataaacattagttatcttccattatcctaaaaacatattttattccaagtcgattttaccttcacttgcaaacttgctgatgcaactctcctttctagatcttctacctgttgaaggacactcaaatccatttccattgcttgttcttctactgaccagttctccacaatatctcgagttacttggttttcttcattttcattcagttcaataatagcaactacatttaaaaagaaattaatttaaaaatccacttattaagcttttccccacagagacctcttccagaaagtgaataaaattctaggagacccatgtacatctaacttgacatacacaaatgcacttgtgtatgtacaggcagcttactcttaaaagtagaaacacgctaagaaacacaaaacaatatgctacgggtgtaaaaaattacaagacagtaacaccaacttaaaaaatataaatagtttgttgagtaaaacagaaaaaaatagtagtgcattaagatatcatttctctcttgatatctgtgggggattggttctaggaccccctctgcccccatgaataccaaaacctagagatgttcacatcccttatataaaatggtgttggccaggagtggtggctcatgcccataatcttagcactttgggaagctgaggtgagaggatcacttgaggccaggagttcgagaccagcctgggcaacatagtgaggccctgtctctacaaaaaataaaaaaaactagctgggtgtgggggcatgtgcctgtagtcccagctactcagaaggctgaggcaggaagattgcttgagcccaggactttgagaatgcagtcagctatgactgcaccaccattctccagcctaggtgacacagcaagactctctcacaaaaaaaaaaaaaaaaaaaaaaaaaaggtgtactatttgcatgtaatctatgtacatcctcccatatgcttcaagttatttctaggttacttatagtacctgagacaatgtagatgctatggaaatagttgttatactatatattatttagggaagaatgataagaaaaaaaagcctgtatatgttcagtacagatgcacccatctttctttgactgtttgatctgcgattggttgaatccatagatgtggaacccatgaatatgaaggaccaatagactgtactaaaatatggtttagaataattaattctcataactaagcaagaaagaaagctgaaatatcttttaggtacacaccatccttattcttgaggcaggcttgagtaatataatccaaatgtttctgaatttgtttttgtaatgccttttctcttattcctctgagatgcagcactttgagcaaagcttttaggtcctctgggtcaataattctccaccaaccaaactgcatttctaagtcaagataaataagtagaacttttacaaatattttgaataggaaatgacaccatggaaataaaaagatttattaactatatatagaaccatcaaatattcagttataatacaggaatccataatattgaaattgagtaagtggctgtaaaccatctcaatgtacctaccttctggaataggttttggactaggaaaatctactggttttgctacttcaacagctgcaggttgagctgaagtggccttttcattctgtggtactggagattcacttttacttgaagcaacattggaagtcaagaatgaattaccatttccttctgataaccctaaccccgatcctagactaggtacagatgatgtaaatggaatattagaagtaaccacaccagtgggccatccacaaaactgaagtcccatcatagatactccacctttcacctgcaaaaagaaaacatttattaatgaaaagtagattactctaagaagttaggaaaaatgtttggaatatgaaattatttttcaaattccaaaaaatattctttcatttattacaattacaggaaaacaaaatacattagcaacaaaaatgttaaattccatgttcttatttgtttcccaaagtaattttcctttcggatataccgttacagtaataagttaaaaagtaattaaagaagacttagacaaagtctagaaatcagtagttctaatgaaccttggtgacagaaattctgacttgttttagttttcaaactgtagcaggaatattttaactatctgagtgagcccccttgagcaaaaatctccatggggtcaaagattacataaagcaatataaaaatgagttacagttagcagtactaacctgaagaggtgataaagcaaatggatttaagccaacaggattctgagcagaagatccaagaggagctggggtaggtgaaggtgacttagatggtggctgagactgaggagtcaccaaagaagcagttgacatatcggcatgagtaagtgaagtgtcatcacagggtgttcgtggcaaaagactaaaccattgtctattcttttcagtcagcgtttttagtaactggtcattggggagaggactgtagaacttccctggaccacttgaaccagtattaaacagattattagagtctgccttttccacattgctttgcgttgctgttgactgaacgctgcccagtgaatgttttccactgttctgataagacaacgtgcacccatttgcaccagcatttggtttgggggtcataacctctgactcaggaggcatcttagctacttccaaaagcttgcttaatttggaaaaagagccaggtttctgaaggaatagatttgtgttatctttttctttaagatcttccttttgttcacagtgatctgtatttgaacaatttaaactgtccccagaagtctcaaacatttcttctttgatctggacactttctgcctttttcagtttttctctttcttttgcaatttcttctagtcctacaaaatgaaaaagcattatgaacatcagttactccagatcaaaccaatactgtaattaaatttcattactctttatcaaattatatgcataaatacttaaacttttctgtattacctaatactccctatattttccttttttatagattatagctttcactcactggaaaattaacatatatatatatatatattttgtttgttggtttgtttacattttattttgagatggacggagtctcactcttcttccaggctggagtgcaatggcgtgaattcagctcactgcaacctctgcctcctgggttcaagcgattctcctgcttcagcctcctgagtaaatgagattacaaaggtgcaccaccatgcctggctaatttttttgtatttttagtagaaacagggtttcaccatgttagccaggctggtctcgaatctctgaggtcaggcaatccacctgccttggcctcccaaagtgcagggataacaggcatgagccaccactcccagccggcattaacatatatttgttataaaaaattaaaatccggtggggggaggggggagggataacattgggagatctacctaatgctagatgacgagttagtgggtgcagcgcaccagcatggcacatgtatacatatgtaactaacctgcacattgtgcacatgtaccctaaaacttaaagtataataataataataaaaaattaaaatccaaaaatattaaaagtacaaaaaatattacaagctgtactacacagcaaaaattacccttaatatttttgtattaaacttctaggagttctgtatgtgatacatacacacttaaatccacataattaaggaaagaaattctactacatacataatattctaaactgctagagggttttattgaataataccctgtaaacaccttgacatgtcgataaacatataacttcatcataaattttaatggcaacagaatgaactatatcataacttaaataattttctactgatatataataataggtcccaattattcactattataaacaatgctgtaaataatgaccttttatctgtatttttagacttgttctcccaatttacttccttaaaataaattcctaaaaaaaaaactaagatgtgtacttttcagagtttttgaaatatactgtcaaactgtcctctaaaaagtctggatgaatatatactcatattaaagtaactgagagcatctgtgtgcctacaccctcaatgaaactggatgctgtcagtattttttgtctttgccaatatttgaggtgaaaatctagattgcattatttctggtcattagtaaggctgaatatcttttcataggtttattggtatttctcttttgtaaatttctggttcatatttttgctcattgttttaaaaataatttataagaactattttaaaaacataaatccactactttattcaatttgaaaagtaatatgctcacaagttaaaatattcagtcatgaagggtataaagtaaaggcctttctacctattccttcaatctctatttctacacttcaggggtagccatggttaattacatcaatacaccttcccagaaatagtatatacgttatctatgactaccattttgcattattacataaatggaatactactattcacttttctgcggcttagaataaaaaccaaactcctaaccaaggcctacaacattctataatctggttcctgaaaacttccaccacctctgcaccactcttgtccttgataactctgctcctcttctcactttctattttcagcttcttgaacatgctaagttcttgcccttctcagagcccttgatcttgttcttccctctgcatgggatactgttttgttgactggctccttatccttcatgtctcagataataaacgttatttccttacggagattttctctgatcaccttatctaaaattaggaccccccattcatcttagaatgtcattctatatatttcctttacagaatttaacattaatcatgatgtttgtttatttttgattaccttccctcccacgtactagaatttaaatcaacaagctctgtttaaaggcagagcaatgtctatatctttttttttttttttcttagatagggtctcactctgtcacccaggctggagtgcagtggtgtgattagggcttactgcaacctcgacctaccaagctcaagtgattctcccaactcagcctccaaattagctgggactacaggtgcacaccaccatgtccaagtaatttttgtattttttgtagagacgaggtttcactatgttgccaggctagtctcaaacttctgagctcaagccatccacctgcagattacaggcatgagctttgggattacaggcatgagccactgtgcccggtcaatgtctgtatcttgctattattggattccaaatgcttagcatggtggccactacaaaacagtggctcaataaaccaggcacagtggcatgcacctgtagtcccagctacttgggaggctgaggtggaaggatcgcttgagcccaggagtttgagtccagcatgggcaacatagtgagatcctgtctctaaagaaaataaaagaaggtgctcaataaatattccttgataacgaaataaaaggatgaatttaattctttcactaacagtattccttagagaactttccaaaacatgtaactgtagctcatctgtagttcatttttgtgatcagctgcacaattttgttatataggtatatcataatttatccaaccagtcctttattaatgtttgacatagccctcatatccttctcttcaaattagtttctagttgaaattaaatccctatacatcagatttatacttctgaccaatatagagtaacagggactagattaccttcttgtatgaaacaaccagaaacagataaaatacatgaaacaacagtttgcaggaaactgaacatcaaataacaaagttgaaaaacaaactcagtgagtcttgtgattgccccagcttactgccttgggacagcttctaggatacaacaataaggaggagtaatccaggtggagcctggcaaactccctaagatgagaagatgcaactgaaagctcagggagacaaaagtggctagagtgctcaggagaatattctggaagggagagagttgcacagagaactccagtgatctgcagaggaacccctcgagtatttagctaaatactgatcagcacatatgtgtgaggcttggtgaaaaaagtaccttaaaggattagaggggaaagtgccaggtgctcacacaggctgggaatagttcccgttcctacccaccagagtgggaaacctcaagattcataggcattgggtagagtactcagaaggatcttgctttaggagcaggggataatcagccctagaatgagcactgttctagttctgcctgacaaagtttaaatgcaagacttgaaaggatcgaacttttccaaggatgtaacttaactgtgccttggttaaacaaaggtcaagaatacaggaacttaaaaatatccagcacccaacaaggtaaaattcacaatatctggcatccaatcaaagttagcaggcatgcaaagaagaaaaaaaaacaagacatatacttttacctccagttagggacatgtgaaaatagtcacaaatattttcctcatatacctgtgtgttccaatccttttaactttagataatgtattagttagtagtggagtactaatatttgtattctgagaactaaaaaaatttcaaaaattgctgtcatatattctaaaacaaataagaaacacacctatttttactagtttgagactagaagatgacttatttgtatctaatattgagctgatggtaatttcaaaagtcatggctatctttgacttttacattcaaattgcttaatcctaacagttaaacctctaattaaaaaaaatatatatatattttttgagatggagtcttactctgtcacccaggtagagtgcagtggcataatctcggttcactgcaacctccacctcccaggttcaactgattctcctgcctcagtctcccaagtagctgagactagaggcacgtgccaccatgactggctaatttctgtattttcagtagagatgaggttttaccatggtggtcaggctggtctcgaactcatgacctcacgtgatccgcatgcctcagcctcccaaagtgctgggattacaggtgtgagccaccgcctctggctgtaaaattacttttaatcatttgaaaatatatatgggatatttagtgtaaagagattctttaattttaaattgttttctatcttttatctcatataatcctctggtctttctagtccttacttctttgacatgtgtcaatgactatagataaccatcttcaaagcagaagaaagaagaggaaggcaagtaagagagaaaattggaagtactcttcacttaattaactaccctggcagcaactgcagtacacaatgacaaaatatcatttcctaatttaaatgaatgctaaaagtagcaaagtttgctactggaaagaagctatgtcttcttgagttttaccagaatcactctgacccctgttagttcacttaattgttctcacgggattctgggggtcaatcattcttgcttccagtgaaccatctttcctttggctccccttagttggactgaagcaagctaaaactttcagagagtttttactaaactctaagtgaaaaagaaaaagcaagaaatgtaaatatagagtacaggttgaagagaggttcaatcacaaatggccccttcctagggttcaagcacccctacccactcagtatggctaaaccttaggagtactcgcagagctttcccatcttcagttgacagtgttaccacaaaccagctcctaggaagcatcttgaagatagtggaaggaagatgctaggaagcatcttgagattattgtggaagagactaaaggaagcagattcttattatgtctatttaggattgttcctttccaggctgatccagaaaattttaagatgataacataaaaccattacccttaatgaaagattctcacatttccatggtagcaattacattgtatacttgcacacttaatgctttaaccatatcctaatacaaaatggaagaacagtattcatatcacagtataattaacaataaacttgtttcagtttccttccaatactgaataaattatctataacctaacatatcccaaatggctttaaaaaaacagtgaacttcttccaggcaagatggctgaataggaacagttccggtctgcagctcccagcgagatcaacacagaaggtgggtgatttctgcatttccaactgaggtacttggctcatctcatcgggactggttagacagtgggtgcagcacacagaaggcggccgaagtagggtggggcattgcctcacccaggaagtgcaaggggtccgggaactccctctcctagccaagggaagccatgaggggctgtgctgtgaagaatggtgcaccctggcccagatactacgcttttcccacggtctttgtaacccacagaccaggagattgcctccggtgcctatgccaccagggtcctgggtttcaagcacaaaactgggtggccatttgggcagacactgagctagctgcaagagttttttttcataccccagtggtgcctggagtgccagcgagacagaaccattcactcccctggaaagggggctgaagccaggaagccaactggtctagctcggtggatcccaccctcacagagtctagcaagctaagatccactggcttgaaatcctcactgcaagcacagcagtctgaagtcgacgtgggatgcttgagcttgggtgtgggaaggggtgtccgccattacagaggcttgggtaggccgttttcccctcacagtgtaaataaagctgccaggaagttcaaactgggcggagccctctgcagctcagcaaagccgctgtagccagactgcctctctagatttctcctctctggacagggcatctcttaaagaaagacagcagccccagtcaggggcttatagatcaaactcccatctccctgggggaagatgcagctgtgggcacagcttcagcagacttaaacgttcctgcctggtggctctgaagagagcagcagatctcccagcacagtagtcaagctctgctaagggacagactgcctcctcagttgagtccctgacccccgtgcctcctgactgggagacacctcccagcaggggtcgacagacacctcatatggtagagctctggctggcatctggtgggtgcccctgtgggacgaaggttccagaggaaggaacaggcagcaatctttgctgttctgcagcctccgctggtgataacaggcaaacaagggtctggagtggacctccagcaaactccagcagacctgcagcagaggggcctgttagaaggaaaactaatgaacagaaaggaatagcatcaacatcaacataaaggacatccacacagaaactccatccgaagctgaccaacatcaaagaccaaaggtagataaatccatgaagatgaagaaaaacgaacgcaaaaaggctaaaaattcccaaaaccagaatgcctcttctcctccaaaggatcacaactccttgccagcaagggaacaaaactggacgcagaatgagtttgacgaattgacagaagtgggcttcagaaggtgggtaataacaaactcctctgagctaaaggagcatgttctaacccaatgcgatgaagctaagaaccttgaaaaaaggttagaggaatgctaactagaataaccagtttacagaaggacataaatgacctgatggagctgaaaaacacagcacgagaacttcagaaagcacacacaagtatcaacagccgaatcaagcagaagaaaggatatcaatgattgaatatcaacttaatgaaataaagcgtgaagacaagattagagaaaaaagaatgaaaagaaatgaacaaagcttccaagaaatatgggactatgtgaaaagaccaaacctatgtttgattagtgtacctgaaaatgatggggagaatggaactaagctggcaaatatacgtcaggatattatccaggagaacttctccaacctagcaagacaggccaacattaaaaaatacagagaacgccacaaagatactccttgagaagagcaaccccaagacacacaatcgtcagattcaccaaggttgaaatgaaggaaaaaatgttaaggacagccagagagaaaggtcgggttacctacaaagggaaacccatcagactaacagtagatctctctgcagaaaccttacaagccagaagagagttggggccaatattcaacattcttaaagaaaagaattttcaacccagaattttgtctccagccaaactcagcttcataagcgaaggagaaataaaatcccttacagacaggcaaatgctgagagattttgtcaccaccaggcctgccttacaagagctcctgaaggaagcactaaacatagaaaggaaataccggtaccagccactgcaaaaacatgccaaattgtagaccatcgacactatgaagaaactgcatcaactattgggcaaaataaccagctagcatcataatgacaggatcaaattcacacataacaacattaaccttaaatgtaaacaggctaaatgccccaattaaaagacacagactggcaaattggataaagagtcaagaccctttggtgtgctgtattcaggagatgcatctcacatgcaaagacacacataggctcaaaacaaagggatggaggaatatttaccaagaaaatggaaagcaaaaacagaaggggttgcaatcctagtctctgataaaacagactttaaaccaacaaagatcaaaagagacaaagaaaggcattacataatggtaaagggatcaacacaacaagaagagctaactatcctaaatatgtatgcacccaatacagcagaacccagattcataaagcaagtccttagatacctacaaagaaacttagactcccacacaataatagttggagactttaacaccccactgtcaatgtcagacaaatcaacgagacagaaaggtaacaagaacattcaggatttgaatcagctctggaccaagaggacctaatagacatctacagaactctccaccccaaatcaacagaatatacattcttctcagcaccacatcgcacttattccaaaattgaccacataattggaagtaaaacactcctcagcaaatgcaaaagaatggaaataataaccagcagtctctgagaccacagtgcaatcaaattagaactcagggttaagaaactcactcaaaaccacaaactacatggaaactgaacaacctgctcctgaatgactactgggtaaataacgaaatgaaggcagaaataaataagttctttgaaaccaatgagaacaaagacacaacgtaccagaatctctgggacacagccagagatttagagagaaatttatagcactaaatgcctgcaacagaaagcaggaaatatctaaaatcgacaccctaacatcacaattaaaagaactgagaggcaagagcaaacacattcaaaagctagcagaagacaagaaataactaagatcagagcagaactaaaggagacagagacacaaaaggcccttcaaaaaatcaatgaatccaggagctggttttttgaaaagatcaacaaaatagacagactggtagccacactaataaaggagaaaagagagaagaatcaaatagacacaataaaacatgataaagtggatatcaccactgatcccacagaaatacaaactaccatcagagaatactagaaacacctctacgcaaataaactaaaaatctggaagaaatggataaattccgggacacacacaccctcccaagactaaatcaggaagaagtccaatccctgaatagaccaataacaagttctgaaactgaggcaataattaatagcctaccagccaaaaaaagctcaggaccagacagattcacagccgaattctaccagaggtacaaaagcgagctgctaccattccttttgaaactattcccaacaatagaaaaggagggactccttcctaactcattttataaggccagcgtcaatacctgataccaaaacctggcagaaacacaaaaaaagaaaatttcaggccaatatccctgatgaacatcgatgcgaaaattctcaataaaatactggcaaactgaatccagcagcatatcaaaaagcttatctgccctgatcaagttggcttcatcactggggtgcaaggctgtttcaacacatggaaatcaataaatgtaatccatcacataaacaggaccaatgacaaaacccacatgattctctcaatatatgcagaaaaggcctttgacaaaattcaacagcccttcatgctaaaaactcccaataaactaggtattgatgggaggtatctcaaaataataagagctgtttatgacaaacccacggccaatatcatacagaatgggcaaaagctggaagcattccctttgaatactggcacaagacaaggatgccctttcttaccaatcctattcaacatagtattggaagttctggccggggcaatcaggtaaaagaatgaaataaaggtcattcaaataggaagagaggaagtcaaattgtctctgtttgcagatgacatgattgtatatttagaaaatcccatcgtctcagcccaaaatctccttaagctggtaagttatttcagcagtctcaggatacaaaatcaatgtgcaaaaatcacaagcattcctatccaccaataatagacaaacagagagccaaatcatgagtgaactcccattcacaattgctacaaagaaaataaaatacctaggaatccaacttacaagggatgtgaaggacctcttcaaggagaactataaaccactgctcaaggaaataagagaggacacaaacaaatgaaaaacattccatgctcatggatagaagaatcaatattgtgaaaatggccatattgcccaaagtaatttatagattcaatgctgtccccatcaagctaccactttcttcacagaattagaaaaaaactactttaaatttcatatggaaccaaaaaaaggtcccatatagccaagacaaccctaagcagaaagaacaaagctggaggcatcacactacctgacttcaaactatgctacaaggctacagtaactaaaacagtatggtactggtaccaaaacagatatatagaacagtggaacagaacagaggcctcagaaataatgccacacatctacaaccatgtgatctttgacaaacctgagaaaaacaagcaatggggaaaggattccctgtttaataaatggtgttgggaaaactggctagtcatatgcagaaaactgaaactggaccccttccttacaccttatacgaaaattaactcaagatggattgaagacttaaacgtcagacctaaaaccataaaaaccctagaacaaaacctaggcaataccattcaggacataggcatgggcaaggacttggtaactaaaacactaaaagcaatggcaacaaaagccaaaattgacaaatgggatctaattaaactaaagaacttctgcacagcaaaagaaactatcatcagagtgaacaggcagcttacagaatgggagaagatttttgcaatctagccatctgacaaagcgctagtatccagaatctacaaagaacttaaacaaatttacaagaaaatataaacaaccccatcaaaaagtgggtgaaggatatgaatagacacttctcaaaagaagacattgatgcagccaacaaacatatgaaaaaaagctcatcatcatgggtcattagagaaatgcaaatcaaaaccacaatgagataccatctcatgccagttagaatggcaatcattaaaaagtcaggaaacaacagatgctggcgaggctgtggagaaataggaacgcttttacactgttggtggtagtgtacattagttcaaccattgtggaagacagtgtggtgattcctcaaggatctacaaccagaaatacaatttgacccagcaatcaatcccattactgggtatatatccaaaggattatatatcattctactataaagacacatgcacatgtatgtttattgcagcactgttcacaatagcaaagacttggaaccaactcaaatgcccataaatgatagactagataaagaaaatgtggcacatatacaccatggaatactatgcagccataaaaaaggatgagttcatgtcctttgcagggacatggatgaagctggaaaccatcattcttagcaaactaacacaggaacagaaaaccaaacaccacaagttctcactcataagtgggcgttgaacgatgagaacacatggacatagggaggggaacaacacacactggggcctgtcgggggggtgagggtctgggggagggatagcattaggagaaatacctaatgtagatgacgggttgatgggtgcagcaaaccaccatggcaagtgaatacctatgtaacaaacctgtatgttctacacttgtatctcagaacttaaagtacaatgaaacaaaagaaaacaaaacaaaaaacaaacaaattaaaaaaaaacagtgaactggactggaaaaaaaaatccttggttttggctggaaggccataggggctttcttctttcccacttccctgagaggcagcagcaggtcagaaggccttcagctgaggtcaacactgttctcagcgtcctccctatgtagactttgacccttgatatgcatatgtcctagcactgtttctaaacccaaaggtcccttgataatgtttatcattactcagaaattaagtgctttctactctttctcacactaatgcatacagggcaaggtgtggggtacagtgtttcgtctcttggagtgctcttgctgcatgtccaagtcctgtggaatcattatggaggctgggaatcctgtgtacggttacttctttgcttgtaggttactctcactaacaaactttgctgctattagcaccatgtgtgttagtggtttgtgtaaccatcttgtactacagttggtgcccaacaaagtcccgatgtcatggctttctgaaagaggagaacccatgggtcaaagaatttctcctggggacagtggtaattcacttggcagttaggatggtctcagtagctacgcctgagaatggcagaagccctcaagtggtaaagagggtttccagtggcttgaaattaagttctatctcttctccttatcagcttagagattttcaggagtacaaattggtagggtgcactagaaagggtgtggtagtctctctagaagggaaggtggggcaaattcccactgtttatctgtaatatgaggcaactggtcctgctgtatgtgaagccagttactgtgaggcacggtgtacaggagcctgagtgagaacaccagcaggaggagatccagcattatacagagcaagagcaagactcttattagctccactactgtagggatagtagaggcttggcctgctaatttgcatggttaggagacaacagtgttgttaagggaagctgagtaaaaggaaacacatgacctggttaaacaatgagcagtctgggttgactaataacactggggctgatgttgtaaccctgcttctaaactggatgcttggtagcatgggtaatacgtattaccattggggtgattttcctgccacttgaatgtgaaatggactagatccacagatagtgtagttactctaacacactctgagacaactggctgtgttagcgtaattataagaaaatccagggtttgagtagagaatccctgacaacatgctcttggtgcagagaatgttggatgaccgaatcagagcaggtcctcctaagtggacaactgctttgacttattccttcatctgggaggcaatgttggacatgaaatagttctttttaggtcatacaagccccacagcagaggcggaaatggaaagagacagggtctcatgagatgcacaggtttctgcccaaaatataaagaaagaaggaacaaaagaaggagtagaccgataggctgaactcaggcaatctccctcacaccaataaatgtgatattgctcataaacagaaggaatgataagacagaaattgagagacggcctaattcttgagtgtgggaatgtagtcctattcaaaaagttaaaagacccactgagactgtggaaaagggacatgtgagatgaaacatgatactgaatagtttacagacttgaataattattgggagaggtggagtcaccagaagattaggtgaagaaggtccctggggaggacgagggctattgagcttcatccacacaaactgataagatctaaaggacatagagacagggagatactctgcattatcttgactctggaagtggcattgctggtgggaatgctcctagtcatcagctccactttgtgagtttgagtcaactctagaagccaagcttctttgttcctaatctgagccctttcaaactcaaggagaaatacaggtgggctcagtcccctttactctcttccaagggatccctaaccatgtaccccagatgattatgctggaaaagagaagagcctccaatatttacgggtttgctagaaatggaggaccaagtatcatagctccagactgcagaagagctctggtaaacaagttcctcaactggggtttggagtccatgttacctatggctgaaagattagaattacaatcactgcaacggcttttggaccttttgcgtgaattctagttgtttctttatcagggtggggtaattaagtccacatgtcagttggactttttttcttttcgagacagggtcttgctctgtccccaaggctgaagtgctgtgatgcgatcgtggctcactgcagcctcgaactcctgtgcttaattgattctgccaccttaaactcctaagtagctggaagtatacctggctaatttttctgtagagatggggttccaccatgttacccaggctggtcttgaactcctgggctcaactaatcctcccacctcagcttcccaaagtgctgggattacaggtataagccaccatgcctagcccttagttagacattttttgtgacttctgttagtagcttctataactgttggccaggtatgttgccaaaacccacctgtacttacaaggtcggcagatgttgtgtgacactatacttacaaggtcggcagacgttgtgtgacagtgttgcacacctagaggtgaaacaggttgcatttcttatacaagaacagactcaggcaggggtactgcacaacaccatttcacaatttaacaaccccgtttgcctaactctgtttgacactagtactgcaagtgatctatgactggtctcaggcagagactctgatggcatgtgttagtttttgggtgtttgatctcctctagctaatgaatggtatacacctttggggttactgtgtctcctgcatttgcagataacatacatattatcaagacttaggtatattattatatattggggtttctagatatgatacaattaagcaatgaaagtgctttcacagctgctggcattctacaatgggaccatgtagaatggtattgccaacatggtactaagtggctgttctaggctcgttcttaaccacgggcagtatagaatgctggaatagcattctgaaagacagctgtacccatccttttaacaatgacttctataagattgtctggtccgggtgacctctgctgtttatactcataaaggtccctccactttggtgaagttccttggcacctgggagtcaaaaagcagaaacagacgaagaatctacttggtatgccaagacctgagtttttacacctcaatagttatttccttttgttgtacctgtcataatttcaacaggtggctgggaggtttgtgtgttcatattacagacaaatggatggatacaaacttggatgctctcctgacttcctgatgacactgctagctacacctacagaagggcaattttgattctctctttattccaaacattctaaatttctgttgtatgcttattctgcaagtgggagattttgctgcagtctctatacccatatagtatactctatccacagagtttctctggtgagaaagtgcaactcctgctttcatgtggaacttactgttgcagaaagaaagaacagaccacataggttgtccttaaagataatgatggactgtgcttgggcataaacgtgcctgaccaaaaaaagtgaaagtgtggttggagcatgaataactctctcttcacctttcttgcagatattaacagactgtaccaaataatcctctgcagcgatcccacacaatgacagtgcaaagctatcacaatgtgggatttgttatgcttaacatactcaactgtggaggaccttctggaaattctactcccagataacaccatgggaattactcctacctggtattaaccagagttctcatttgccctggccctccattaactcttcccttactagtcatgctgtgtaaaactctactcaacttctcaggtgcagaaaacacctactcttacatctcggctcccagtggatccatgccccacattaggagaaccccaaagcagcataaaactctcaaccaaatacttccacttcagacctgcagttgagtctaatagcatgccgacagtgtgttaaccccagaaaaacataaatgccaagtggatataaaatgtagcattaaacctctgtaatccagtggaacctgtcgtcttatgtgaaaggcatgcttaccctgcctcccacctgtaaataacactgcacattttggaagtactatgagacctttaatagtgactcaaaatctaagacactggtcacttttccagctgtggtctccagggctagcattagagcctatctgcaggtgtcaaggatacaagctttcattactttgtacaagggctcttgccttgaatagtcacctacgaagctgaggatatgaccagcaattgctatcatgggaaacgctgccattgagaaagcctgggatcatatcactgaaattagtattgcttccttgacatgagtaatattagagaattgcatagctttggactttttgttggatatgcagccagattgctcatgggagctctgtatctcctaatgctgtggtatattgtttgttttagaatttctctggctatatgactctttcagcactgtcaacaaacactgaaggcaccatttaaaatctaattgctttctattgcagatggggacgcatatatctagtgagccacaccaagggtcagggggtggactgagaaggaataaaccctcagtcttagctaaatgggcatgggggctctcttccttctcttgttcccaagacccatcagcaaacctgcttagccaccgagctgatgtgcagaggaacagtagggtctttagctgctgttctcaaagtccttggtttgtagatcctggtcctttgtaatgcaaactccctagtgttgttcctaggcccagaggtcctttgagatatatgttgtttcttagaataatgaaggacttggactaacctcgaaatatatagtggtatgaaggcagagccttctctttgagtgatcttgtttcttgtccagtctctaactggacaaggcacacccctgtggaaccactgtaggggctcagagatcccctgagtgctctgttacttatctgaagttatcatcaccaataaacattattgttattagcactgtgtgtaatgcttgtggtatatattaccttgcctcttgtacaacacgaatttaatttaattaatatttttctgtgaaggtaatccaatgtctgatatcttctccccataatattaattgatgttaatgttattataagaattttttaaaaacttgtacatttaatgttaaatctaacctttctttattaagaacacattatacttttaaggaacttttaaaaagtaataaataagcagctgggcacagtggctcacacctgtaatcccagcactttgggaggccgaggtaggcagatcatgaggtcaggagatcgagaccatcctggctaacacagtgaaaccccatctctactaaaaaaatacaaaaaaattagccaggcatggtggcagacgcctgtagtcccagctacttgggaggctgaggcaggagaatggcgtgaaagtgggaggtggagcttgcagtgagccaagatcgcgccactgcactccagcctgggagatagagtgagaatctgtctcaaaaaaaaaagtaataaataagatgatgacaataatgtatattgttaatgttgaattaactttcagcacccatttatttacagtagtttctactagtttgacacttactgatctttatcagccttgcctgtcagacacactacgtgctcatattatacacttgtatgttctctttgtcttcatacgtgctgtatctttccaattagattgtgagctttttgtggatagggacaggttaactgattcttttgcatcttgttttgctcaagtgatccccctatgccagcctcctgagtaactgagattacaggtgcacaccacagtcagccatatatatgtgattttagtagagacaaggtcttgctacgttgcccaggctcgttgtgaactcttgggctcaagcaatcctcctgcctcagcctcccaaagtgctaggattacaggcatgaaccagtgcacctggtcttcttttgcatctccacagcacttagtacaaggcacaatacaggtgtaaataaacacttgatgaataaatcatctgagttttttcctcattttaattagctgtaagataaagagaaggaatctatacctattatttataagttcttagcacatagaatacagcagacgtatattcccttattatttcattaatgtctattaatatgtctattaatgaaataaaaaacttcagaagaaaataaagtgaaaaattatccctacttccccctgctctgcaatgaccacaaataagagtataaagtacaactgctatttatatatcactttgcagttgttttagatccattatctgacatgatccttgtaacaatcgaagaattcatatacagcttattaatatttttttgcagaaacagaaatcagtgtccagagaggttatgtagaagagcctggatggaaatggaggtctaatatgtaaattcaatcaatgataatctgaaaggcctaaaaaaaaaaaaaaaaaaaaaaaaactgtctcctataagctattcttataaaaccttataaagacattaaattatttatttacttatttaaatcttaaagtattttaagtgtgcctgtgatatataaagtactatccttccaacactatggaaaattaaaagcacagatgaagattataagatttaaataaggaaatagtatatatattaatgtgctaaaataatggtctaattaattatctgcttttctgggagttcaatttcacgtttattaaaaggtccacttaaataagctgggaagtttgtggaaaagcttaggatttgagctggatcaagaaggatgggtgaaatttcgatggtagaagaaaagcagattattattataataaacaagatttggcaaagatgcaaggggaggaatacacatgtgttcagtgagtagactggactagttgaattctcattaacagaacagcataaagacagcttggggtcagaattgtatacagtcttgaatgccaggctaagtacatatttaactacatcatgttacaggttatagaggtcatttaaggtttcagagtagagacatgatatgatgacagaatgtgatggaaggagggaattgtatatagagaagttgaggacaggtgtaataatccaggtatacaatgataaagaactgatttcagtagtgttgcaaagagactgatttcaggtattttgaaggaaagttgatgtcctagatacttcaagtttacatgcccaagtgactaagaagaatgtggctcttaaacatattgaatatttaactggtctggggtagggctcagattgatcattttcttaagcttttcaggtgattcataaggttaaaaagccactcacctaggcattaaaaaaaaatctttgttggacatttgagttggttccaagtctttgctattgtgagtagtgctgcaataaacatacgtgtgcatgtgtctttatagcagcatgatttatattccgttgggtatatacccagtaatgggatggctgggtcaaatggtatttcaacccaaatgtccaacaatgatagacaggattaagaaaacatggcacatatacaccatggaatactatgcagccatagaaaaggatgagttcatgtcctttgtagggacatggatgaagctggaaaccatcattctcagcaaactattgcaaggacaaaaaaccaaacaccgcatgttctctctcataggtgggaattgaacaatgagaacacttggacacaggaaggggaacatcacacactggggcctgtcgtggggtggtgggagaggggagggatagcattaggagatatacctaatgtaaatgatgagttaatgggtgcagcacaccaacatggcacatgtatacatatgtaacaaatctgcacgttgtgcacatgtaccctagaacttaaagtataataaaaatatatatttattaaaaaaaaaactgctcttaagtctcctaggcactgtactaccttttttttttttttttttttttgagacgcagtctcgctctcttgcccagtggcacaatctcggctcactacaagctccgtctcccgggttcatgccattctcctgcctcagcctcccgagtagctgggactacaggcgcccgccaccacgcccggctaatgttttttgtatttttagtagagacggggtttcaccacgttaaccaggatggtcttgatctcctgacctcgtgatccgcccgtctccgcctcccaaagtgctgggattataggtgtgagccaccgcacccggcccaggctctgtacttctaaatgacccatacttttgtcattttaaattagatcctatactaaaactttgacttaatttcatttcaaacaacccctcctattgactgctctaattcattttaaagtatcattcatttatttatttatttagagacagatcttcactcctgttgcccaggctgaagtgcaatggcacgatctcggctcactgcaacctctccttgcctcctggcttcaagcgattctcctgcctcagcctcctgagtagctgggattactggcatgcgccaccacacccggctaatttttttgtatttttagtagagatgcggtttctccatgttggtcaggctcgtcacgaactcctgacctcaggtaatctgcccgcgttgacctcacaaagtgctgggattacaggtgtgagacaccgcgctcggccaaagtatcataatttttgttatgtatgtatatatgtatgtatttatttatttttgagacagggcccgctctgccacccaggctggagtgcagtggtgcactcttggctcattgcaacctctgtttcctgggttcaagcgattcttgtgcctcagcctccagagtagctgggactataggcacgtgtcactgcatctggctaatttttgtactttttgctagagacggggctttgccatgttgcccaggctggtctcaagctcctggcctcaagtgatctgtctgccttggcctcccaaagtgctgggattaaaggtgtgagccaccatgtctggcccataatttttctattgggaaataagccattaaatttatctctaatttccactttcctacattatactcaataatttcttacagcaattcaaccttcaagatccttctttctgtcttccttttatccctgtttgctcctgaggttatggcctccctacttcttagctgggttactgtaacggttccacagtcagtttctttactacttcttccaatccaatgcgtactttgctcccaggttatctattttagtgtaattcccctgccaaaattagtctctgttctccaagagctcacagtctagtggcagagatggccatctgtaccaaacattatgacaaaatgttaagtaaggtacataatgtttctcagctttgatccctctaggcacttcactttcataggttctgagcttactctttagtgcagaatcctaacattattagagatgcctctgggatcattcctgaattggaaagcaagtatacagaacagaggtctatttgtataagctagaaaattctcccaagtagatcaatcagaacaattcatttttgttagatattgagattctgcataacattttcatttaaaaaaaagtgatcccattactaaaaacaaaacccttaaaagcaactgctttatttatattttctattagagtcatctatatgattagccagtcttctctccccagtggactataaacatgacatggattctattttatacagctttgtgtctcctacagtgcctagaaatgtctagcacatagcaggcattcaaaaatgtgttttatcttccatgtctgatggggacaaaagtgttaatgttagtgcttacagattttcagaatgtaagaacatttttgcttccatgtaccaacatgagtcaatagctattctaaaatatataagcactaacataacacttttgtccccatcagaatttggcatttgaaaatgtccagacatggagctctgaaaagttaaattcgagaaggtttactgagcacataaatgcataatgcactctgctagttaatgtaacagaaatggagccagcgaaagaaatctaaaggtagaatatcatgaatttgtggtaacacaaaattcaaaaaaggaagaagtctgaaggagaaggaagtgatcacaaatttcaaacattaacaagatttgaaaaggaatgaggattatgatgaagatcttagatttaagcaagttacctgcagggggttactgtcaggatgtatgcttattgtaaaagaataaaccacttattgggaagtttgacaatgggaagaaagagaaatggagcagcagctataaaaggtaatatagatggaaatacaagtctctgtccaccaaagaaagaaagaacagcttatgtctgatgtcagaaagagtagcaaaagaatatcaagggctaggaggaagtgtgtatcagtgaaggggcattatgagtgcaaaaggaatgagaattaaggttttacatgtttaccaaacattgattatgggaacacaaaatatattgaagaagtaacagagttttaaaatatatagtttcttatttaacaatttgtatcggattatgagttctaaccttcaccactctccatgccttctacaaaaatccccccacattggggaagaatccagtaccggcgtctgtaacgatcttggccaaacatcactgaacgcaatgagtgagacgcatcaaagagcttccttctgtactgactctgttgctgttaaaaaaatggtacatataattaggtttgggatgttaaatgctttaaaaattaatatatatgtaactttatacttattgtacctttaagcacataaatttcactactgggaaaagagcaaaaggtctaaatattcatgcctgacttcaatttcagtaacatttataaagatagaaatcattttaaggataattatttttgttgccatggagtaaaaggataagctacctgataaaataaaacttatccttttacttgataataaacaatgggatcaagtattttatggagccaaagcaaactggttcaattcaattctattgcttacagtatataacaaataatacatataatatggccaggcacagtggctcatgcctgtaatcccagcactctgggaggctgaggcgggtgggtcatttgaacccaggaattagagaccagccttggcaacatagtgagaccccatctctacaaaaaatatgaaaaatcagctgggcacggtggcacatgcctgtagttccaccaccagggaggctgaggtgggaggatcgcttgagcctgggaggtcaaggctgcagtgaccacgccattgcactccagcctaggtgccagagcaagactctgtttcaaaaagcaaagcaaaacaaaaaacaaataatatatatgtaattggctaaacctgtatttgcctatgtttacactcatgttgtaaacctagacaacatataattaagttttgggataggtctgtgaagaatctaatattaataccatacacaggcatctcgtaatacctttgaaaactcatttttgttcttataaaaagctcatcttaaatttcactaatgctatgaaattcagtttttcttagtttttttttcttttttttttttttttagagacagggtctcgccatattgcccaggcttttctcaaactcctgggctcaaacgatcctctcacctcagcctcccaaagtgctgggattacaggcgtaaaccacttctgaaatggaatttttaacaagatgtatgtaaatacatccacagtttacaaatccaatgcaaataaaacccacaaatatacaaatgtaaaataaaacctaagatgctgaaactgttactatgaaattcaactgaattttttagtaattaattccaagaaataaaactatgccttaattgacattttgtatttatatgaagagctgaagagtatagaatattttctttctaggctctgattaagttcaatatcacgttttaagaggcaggcttttaaccttggcattaagcttgtaaagttcaattgtaagaatgtttctagtgttcctcatcttatttttttttctgacaaaaatgctattcagaatcttcatttttaattactcaccaaaagcctatttttgcttagcagtcagaaaaactaatccccttacaatgtagatttctaaaacactgtgaagaagttaaatgttaatcagaaaagtgcttactttactcagtttttcaatctgtttttccagctcttcaacacttgctgcttggtcaccttcatcctatacataagaaaatacagtgtcatttatctgttttaagatttatttattcaatcagtaaatatttaatgaaagtctcctataggcactgcggaaaggtattaagactcagttcttttctataaactaataatctggtagagagatacataaaacattatgtttaaaaaaaacacaaaaacctaggtatggtagctcatgtctgtaatcccagcactttaggatgctgaggtggcaggatcatttgaggccaggaatttgagaccagcctggacatcatagtcagacccagtatctacgaaaaataaaattagcttagtggcttgttcctgcagtcccagctacttgggaggctgacacaggaggattggttaagcccagaagttcaaggctgcagtgagctatgatcatgccactgcactccagcctgcagaccctatccccagaagaaacaaaacaaaacatagcaaaccacacacacacaataaactcccccaaagcaggaaagtataagggtctcaaagagaggtagtgattaaaacctgtgaagttcaaggcagagtaagactacttttagtggaaatgtataccaagggaggctttatgaagaagtcatgttttaattagctactaaagaatggttagaaatgcatccagcagagaaaagagtctgacatgtcttgacatgagaggtgcataaagaggtaaggtaggagatgaggcaagatgagtttaaggctagattttgaagagctgtaaatgcttggcaattaacaaaatgatcctttgagggtgggttaaatatcagaactatgctttccaaaggttgttctggcaatagttgtaagatggtgtggagcagagaaaggattaaaattggtaaaactagctaacagattagagaaggagggatatggttcttactagcataaaagaaataaagatggaaaaaagcaaatggatgtaagagatatcacatagttatagagctgttaagtcttgccagctcatgaatatgtggcacagaggggcaagggagatgatggaataaataaattatgatgttaaggttttaaatctaggagactggaaaaatactgatactatcaactgaaggagttatttttgaagggaagaagattagttatactatatacttgatatacttgaacacattgagtttttagaataaaaataattcctaacatgcatagtcctaatttcataaatagaaggtttgtaagtaattgtgtgaaatttgtcattccagaaaatgacaacagaagaactatctccaaattgtaggttttagagggaaagcatgaacagaaggtacacgggtttctttggatcttatctgcactactagacataggcaaattacttaacctttgtaagtctattcatctgtaaatttggtgataatgttacctactacatgaaggttttgtgaggactaagtaagaacagatctgaaagtaaccaacagtgttcctactttaataagaagatgcaggtacagcccagattaaagaaaaataacaacttgtttttgatgtttacttcctataagcatttataaaaagccacactgtcaccaaccacacacaaatatatatttctgaccagtatggctactacccaatgaaaaaaaaagtgaaaaaaagactcccatagttgtaccattatctctcattcatccgctccttacccaaacttagggaacccagttacaaaggtatttaggcacattatttgtgctaacagtaacatgaattctatttggaattaaaagaaaactcaaaagataactagctcaacaactcttaaatcttgacttttatgtgaatatttatatatagattctaaaatgatcttctgatcagcaggacaaatgtctgataatctgttcatgcaaaaatacagttcaatcaataaatattcaaaatagatatcaaatatttgaaaatgccatgtatcagccaaatattctaactgcaatttttaagactcttcctatgatgcaaaaagaaataaaatgtctcctaaagttttatttaaaggagttttggctaatagtacttaaaattttcagacattaaaaaaaccttggaagaatagacagaaaggtagtagcagcaacaacaactaagaacacagaatctatcccagtcacagttccccaaccaaaaaacagcatcattatatgtccctatatgtcagagtttaattgtccacagaacctctcacaggccaacttgtgaggttaaactcccataggtctcaacacaactctacggaatgaaggaatgaagagtgaggagaagagggaattctctttgagataaaggggctatgatctagtcaagggcagtatcttctaattgaaagggatcctatgggtctcaataagaaaacctccctgccttaaaggaaaaatcaatcctttaaggaaggtaactaccaataccctacttaaaacttaactgagaggccaaatctattttttgagaactaatgtgcctaacttatcaatttcattaagtagtcaaaattttacttacataggaaattgatgtgtctgccagttctttattataaagaataattcaaatcatttaacatgaaatgttaatttgacttattaggtcctaatatttattactttataaaattttgaaattgttttctcacattactaacaaggatctacctttgccagtgaaatcctaaaatctatttaactctataattcaacactcataaaaaagtgaaatatggctgggtgcagtggctcatgcctgtaatcccagcacttcaggaggccgaggcgggtggatcacgaggtcaagagatcgagaccagcctggccaacatggtgaaaccctgtctctactaaaaatacaaaaattagctgggcgtggtggcaggcacctgtaatcccagctactcgggaggctgaggcaggagaatcgcttgaaccaggaggcggaggttgcagtgagctgagatggtgcccctgcactccagcctgggtgacagagcgagactctgtctccaaaaaaaaaaaaaaaaaagaagtgaaatactaccttaaatgacacatctcctttaaaactttaataatgattttcaaatagtctatgtgtaaagaataaaatgtatggtttgttagttctctgttaaaaaagaaaccaagtgaaacaaataatttctgtaaataaattctagtttagtaagataactatacaggggaataaactaaaatcccagtacatagttgtccaagttattgaacttatgagttaacactttaaaacaatttataatgtgaagtgctaaaagaggctactaattctatgaaaaggtgattaattttggtcagaaaggcttaattcctgctatggaaacagctccacttgccaaatgaagcagattgcttataaatgttatcttttgtttgggtaattacacttctgatactcaaattatatacccttcatattatttgtcacagatgaatgtacataattcagtagtttcaaaagtataatattatgaaataaattatttctgcaaggaatctcaatgtagtctcattttcagattggtactcttaaaagcagtaaagttaaattcattacaatgagttcttgaatatgacatgaaaaacacagggaataaaagcaaaaacagacaagtggcactatatcaaattaaagtgcttcttcatggcaaaggaaacaacagactgaaaagagaacctacaggacaggagaaaacatttgcaaatcatatatttgataaggggttaatatctaaaatatataactcttacaactcaatagcaaaaaccagataaccagattttaaaaatggcaaagaacctgaatagacatttttgcagtgaagacatacaaatggccaacaggtatgtgaaaagatgtccaacatcactaatcagggaaatgtaaaatcaaaatcacaatgagatatcatcccacacctgttagggtaattactctcaaaaagaaagagaaagaaagagacagacaggagtgttggcaaggatatggagaaattggaactctcatacactgttgggagtgtgggattgtaaaatagtgttacactgttgggagtgtgggattgtaaaatagtgtaaccactatggaaaacactataaaggctcctcaaaaaattaagaatagaactatctgatcctgcaatcccacttctgggtatttattcaaaagaactgaaatcaggatattgaagtatttgtgctgtcatgttcattgcaatgttattcacaatggccaaatggtgaaagcaacccaagtgtccactgatggatggatgaataaacaaaatgtgatatatatatacagtgaatattattcagccttaaaaaaatcctgccataagtaacaacatgggtgaaccttgaggacattatgcaaagtgaaataaaccagtcacagaaagtcaaattctatatgattccaattatatgaggtatctaaaacagtcaaactcatagaaccagagagtagaatggtggttgccaggggctgggaggacagggaaattggggagttcctatttaatgggtgtgaagtttcagttatgcaagatgaataagttctagaaagctgttgtacaacctcatgcccatagttaccaacagtgtatactgtacacttaaacatttattaagagggtgaatcttacgttaaatgttttaccaaaattaacaaaaaagaaaagttcattctaataaattttaccattctgatttaaaatacaacattggaaatggagaatttatgacaacattttgtactcatgatatttttacttaagaaagagaattatgtagcatattataaattctacattgattcataaatttgattatcattggttccaactagatattattttcacacattccatcgataaattcatctctcagctttctttcacattccattgataaattcatctctctaagctttctttatttctccagcattactgagttgatgcaataagggaaaagagttctttctagacttccttagctaagagctcttagcattgagggcagaagaaatagttagctgcatgttgttttttgaggtcaattccacagccctatctagcattcttttctgataaaaggtgaacttcaatcttttatatgtgtccattttcatgacttatggtagctttccctaaactcatatacatacacacacacacacacatccctctatgaccttgccttcttccctttgacctactcttcaaaggtagctccttcaccttgattgaagcccctccaaaatctttagaaccttataccacagtgctttttaaaatttcttttatcttaaatccccttctctcattttattgactcttttctttccatcaaaaatcatctcgtctttaacatctgtaaaatccttggctccttctcctgctctaggaactccctgtcttctgaggcacaatgcttgaaatagtcatcttcattttctcactttctattgtaatcaatcaattacagcctggtaggtgtgctcatccctctaataaaactgtgttgacactggttaccaatgacctctatgttgccaaattcaatcaacatttttggtccatatcacactgctttaacactgtttatcactctcctttttgcaatgtttgattttcttgattactgttattattacatgtgtagaaaagacttaacatagcaggcctgattggtatcctctggaaggccttcttacaaggttggtccttggcctggcatatgggaacttggattttgggagggttaagatgagctcttaatatggacctgaactatttgcgctaacaatgtggattatgctgaatacctgcttttcttcagggaatctgatattttggcacatgctatgcagagggtacctacaggtaccagcccccagtaaaaacctggacactgagtctctaatgagcttccctggtagataacatttcatgtatgttgttgagtgaattaagcctgtcctgtgtgactctgctgggagatgactcttggaagcttgtatctggtttcctctggactttgcccatatactctttgctgattttgctttgtttccttttactgtagtaattcattgctataagcacaagtatatgccgagttctgtgaatcatcctagtgaatcactgaacctgaaggtggtcttggggacccccaactcacagaaatctctaacctctctgctcttgcttcttgaacaaggagccttgtgggctcctattaaatactgatgttccctgaggttccaacctcagtccactactctattcactaaaccaatccccctctgtaatcttattacctcatgattttaaattatcatctacctgataataacacccagatctatatttctaagagcaaactcttcttcaggcctcagattcctaaatctaactgactgctaagctcctatacatgggtacctcaaactcagcaagtccaaaaataaataatcatttcctgtcttcaattatctgttcctttacctccccctgcccccaattatctacttactctgttcctgatttccctattttagttaatggcaacaatagcatgaagtcttccaaaccagactgctggaaatcaatcctaccactctaacaacctacatagtctaccttccatcttcaagtcctgcccattcttcctcctaaatatttattaaatcatttcctccctcatcccaactaccattgctctagtttctacccctcacaactcatctaaaccattgcagtatctcctgactgatctctgcacttctgatgttgccccaccttttgtgtctttctcacagctgccagagtgagtaacttaaaaattaatgctgaccatgccattctctgattataacccttcagtggcttcctgccactaaaaaagcaaaagatcctagttcatcattgttgcatatgagactccagtaacactgaagcacttgcaatccccttaaagcacattgtggtttcctgcttctgtgcccttggtcatgcatttctctctgcctggaacactcttccctagacctttacccaggttaatgttcagctcagcttatagcctgagctgatgggtccagaaactctttgtgggagtttattactcagaaagtctaaatgctcttaagttgtatctgcctagcacattgtcaatacccctctcaaagcagttatcacattatgttttctttttgcaaatccttctcagtgagactgtaaattgagatgggactttcagtgccttattcgtctttgattaaaaatacctagaactagagaaatagtaattggtgtttgaggaatacattattttcactaaacctgacaacacttttaaaggcatgaagcgctgtacaaatgtaacacagtatgttaacagaatgaaacaaaatacctgaaattaaaaatctgcatatctctttggagaattctcaagaaattatattaaaaaaacttcttttattcagtcttagtgtcttttatgtatagacattctacaagatatttacataaccatcacaaaaatctttatgggatacagattgtaatatttgtttttcagatgaggaaactgaggcaagtaaatgtcaaaactgaattcaaatccgaatccatctgactccaaattctgtttttaaaaatatgttatgcagttctagttgtcttaaaatcaacctaaatttcattacctcatcttcacagatatcagtcttttttccttttttgtcttctttatcttcttcatcctcatcatcttcatccccttggtcatcactgtcatcgtcatcatcatcgtcataatcactgtctcctcccttccttcttcgcttgcgtcctggagtgggtgtgcccaagggatgctgctcttctcccagatcaatgccacctgaagtgtctcttttgcctgttttcttagcatgaatgattctgagcctttaaatattatgaaaagtgatgacaaggaaaaaaagacttctcaatatacttttaaaagagcaaaacatgagttgtatgcaaaaataccttatggcatttcttttgtgttaagcgatataccaatgttaaaaaaaattagaattaggaaacttaagaaatgtttccataaattacaggatgcattcactttcaagagttattctagatatctctttggaattagactcattaaaaaaaatgatgaaagttgaaaagaagaattctaacaatggctgagtaataatttctgatcccatactaactgactgaataaatttcaattcaaattactacaaagaaactaacctcttaacataggagtaatttctgcctgatattttctggcaggaagataattaagttttaatgctgaataagtttagctagattccgtaaaagcaaattttaattagaaagcaattaagaaaacaagttacagttccaaacattctgtttgtgataaaagcaacttaatagcaaccacaatcttagaaaatgtaattgcttgacttgtttaaaagaaaaagagaaaatgactttcttctaagtatgaagaatataagctcaatgaatctcattatatcttttgtccattgcaaattctgcccctgagttttattaattttatatcccatctaaattgagcattatcttttctttagacaataaaagtttaaattctatctttgcaattcatatgctttactgggaatttgtagaaaaagaaaacagtacattaactttaataaaacaggacttacttgcggagtttaccttctaccacccatttatctctcctcaagtttgacatataatcaatgttcttgtcgatttcactgccaatgcaagaatttattaaaaagtgtaaattaatcaatttatgcaatgcattaatttgatatgcaataaacttgatacgtaaattaatgcatttttgaataagtaaaaatgatacaactgacctcatgcatatacacgttcatatatgtatgtgtttatatatgtatacacagatgttgaaaagtgataacttcttcaatggatacaacattagtattagaaaattcactgtggtttctatcttaaaccaagaaagaaactatgcatcaattgccttagaaagacaatattccaagttttgttgcaggtattttaagatgtgataatttccaaaatcaaagcaggataccagaacacacatggatatttacataagtgcacatacatacatatgcatatacactaagtgtatatatataaacaaccaaacagtaactaagaatattatgatattctttaccattctgttttactttaccagtaaagtcaaatagggatgctttttcccttctaaggcaaaaaccatagtgtaccatttacattgaatttgggtgtatgtgttttgaataagtgccacttagcattactatttgttatcatgctcatgcttaaatgaaattattctttcataaaattgtaagacgtgaatattattatattttttaggatgactgtcagtgaatagcagaaacaaacaaaaaattacattaatacaatatcatagctaagataggtacagaaaacttaaaatttccacactggtagaaatgcatgaccccgaatatttggattgatcctttttctagaaaggtaaaggactaaaagttgttaaaaatctgtaaaataatgaataacaaggacaagatgaacatgaatttgttcagaaatcctgaatactagagtacatgttggtattagtattttactagtaacaagtactagagtgagaactctgacttttaaataggatcaaatgctttaaaaaagtataaattaatacactgataaataaatactctatggttctattagcatacaacaaaataaaaagtggctacgtaattctgtgaatggctactaagcaaaatcaggtagtcatctgtccttaaaagacgtgaaggaaaaaaaaattctgtattcttgtggtggtaccacattctggtaccatagcaactaaaaatataaaaaaagttatgtataaagaattaacagaattattaaacaaaacaggtgacaaagaccacgtattacagacacacagtataatccaaattttttttcaatacactacaaagaaatacatgaaaatattattagtggccatctctaaatactgagataagtacaattttaattttcttctttgtgctagtctgtaactttccaattttctataatcaatttgtattactttttgattagaaaaattcaaaatggaaaaatcacggaaaagcctgggcatatgctcacctgaccacactcttgctgcatgccagttcattgatcaggaaagccaggactgaagctttctgtgctggagtgtgagcctgaaaagctttggtcttcagactttcagtaagctcagtttgtccacagtgggcttccataaatatctgtaaaatctcggaaacattgtctcgattcacaccaacattcagcaaatgttctccaagagctgttttagcctataaaagtttggcatttttatcagtattactcacaaccatttataccataaaaacaataagattaaaaatcctcatattatttgatttagatactactgacaagagctttattcactttttttttaatgaaagagacacaaaaatagtcaatagaagacagacaaatattcaagtatttgtttctttctttccccgcttcaaatccttggttccaagtcaggcagggagaagagtatgcaaattcatgggtagcagaagttttaaattacctatcaagccttccatgactataaaagcgacaccaacctttccccaagtttcatctggatattttatcaggaatgacagagtggggaggttaaaaaacagtattgttttctacccttaaagtgttataggttttactggctggggataataaatagggaaacactgagggagatagaagaaaaacaggtgcatctgggaggttctctctccacaatattatctagagcaaagctccctggaatgtatactgtatttggaattaagataaacatgaacttattgaggatccactgagcagcacagggtcttaacgtgctggtctgtaggtgccttgattagcttcagttattcacagtgattgagagagaacaaggtataatatcagaaggcacatacaagttctagttgccttatgaattatgaattctgttgttgatgaatatcgcttaaggatttccttaaatcaccttggtctttgcctacagctagaggaaaaaagaataacttgagaatggtctacattccttaagctttataaccaggttttctttgtatgaagtgtaacctgacacaaatctacagttaactttgtgagacattatgtggaaaaattagatcaatctatataatcttctgctaatatgctaaagctatctaccaatgcactgacagtacaaatttaaaacattttatattttgtttttttttaccttgtatcctgttattagacctggatcacatacagcagctgagaggagcctcacaagcaagtcttgtacttcacccatgctgtcccctatatttagcaatccctcttgaagaacactcaggtttggaacatcaatattcacatcaaagcccaaaactttaccaaagtttcgtaagaactgcaccaccatgagacagtctgaaaatgtacttccagagagaacaagtcctggaatacgaggcaactctggcaaaggctgaaaataaaatgaaatacaaataaaataaaaacagcttaattttttaaaagccatgatttcgtatcttctaaagtaaaataagctgctaccttttttcccctcttgtattgtaccagtagcttcctttgggatgctaaattctctgggggcatttctgtaacccccatggaactaagcatagtgtcttgaagtatcttcatacaagtaagcaaccattaataaattttggttgaactcaattatgaacttagatctttgcaaaagagacattaattttaatcaacttgcatattcaatcaactgacatatccatattaacaaaacatggattatataactggagcaaaaattaaataaaatataaacatttcaaaagtactttaccatggacatacttataggggcatgtgcaccaatttcttctaatgatgatgacatttaaaaatcacactttttttgtagcttagaaacaaacagcatgcatctgtgggctctatggttggagaaagtggtaccatctatggctaatgaatgcagataaataactaggtccacataactagaatccatgaccctgtacataaacccagttataatgcaactaaaggtctttaggtttccctgtatttaggcaagtattagcttcagtattaaaattagctatctctgttgttatttctcaaatatgctcacatattaacattttaatgacttaattgcagtaccagttgtcatcaacattttaaaatttcaataaataggtaatctgaattaaaaacattttgcctgttaatgagagcctaaaaaagtactttaaattttaattggaaaaaaagtgacataaatatttctatttatctgaattggtccttgttcaaaaatatttctccactctgcatttattgaggtaaccaattgaagactttttctgttaatactgtgtggaaacacaaaactatagataatagctcatctcatacaaatattttatattcttcttgaaagccagttaattctcattctccctttttcttgaaccacaggaaacatatacatttctatgtaattctaaaaatttatgtagcaaagctgagctattaaaaatatggcttaaaatggacttacatatttgatatagtacatatgaatttaaatgaaaataaaagatacaagaaaatgaagctcacttaggatttaaaaagcttgatcactatgagcttattaaatgtgttaactaatttatatacccattctctgcttaggaaaatttaaatatccaaatgactacaactagtaagtatactctcatttttatttagaagcatttatgctaagtaaataaatagaatattaatatagttcaatccattctagagtactaaaagttttctttaagcactttagaaaagagcttacataattgagttaatgggtgcagcacaccagcagggcacatgtatacatatgtaactaacctgcacattgtgcacatgtaccctaaaacttaaagtataataataataaaataaaataaaaaaagagcttacataaatcaagagataatcattatttgcaaatcatttgaatattgcatataagtaaatacatatcctactaattaagtataataatatagagatgaaatgcattattgatatttttctagaagtaccatcttcttaactatagtcaaaacatcattgatttttactcaaaagtatatgaaattatgctggttgccaagattacagcaatgtttctaaatttatacttttatgtatttcagcaacattacatgtctgtgaagcactatggaagacaaaacacatatgaggtgctttggttggacacagtttcttggctttcaggatgataaacagtataggctctggagtttaacaaactggagtttgaatccaaatcgccatttattagttgtgtaatcttgggcaagttccttaacctctttgtgtctcagttttctcatgtataaatgggaagaaatactaactccacaagattgtattgaggattaaatgagaaaattcaaataagtgcttagcacagtcctagcatgtagtaaacatgttcaataaaggtttgccacctaaagcactgaaggaggtcacagattataaatcctcatttatttaaatatccatagggatgtggggaggagttgagatttttctgtgcctggaatcccagaactttgggaggctgaggtggctgtatcacttgagcccaggagttcaagaccagccaggacaacataagagtctgccgctacaaaaaattaaaataacaaaaacccaaaaaactagccaggcatggtggcaagcgcctgtggtcccagcaactcagaagactgaggtgagaggaccacttgagcctgggaacgagaagttgaggcttcagtgagctataatcctgccactgccctctctccagcctaaatgacagagtaagaccctgtctgaaaacaaccaaccaaccaaccaaccaaccaaccaaccaaacaaacaaacaaaaaaaccgccattaccagcacaagagctccagagaggtttacttctagctatctaggaaaggcaaattgacctagagttggaaattcactgctatagttaaaaatgaaaggctttcacaatagcagctctggcaaagaaatcaggtaagaaaactggaaaaattaaacttatgaatgaaatggtgtacatgacgtataaattaccttttggtctgctaagcacatgtcttcattaggcttctttagttcctttgccatttctaattctaatcttcgctgctctagtttacgctctttatttaatcttttctcatcacgtttttcttgtttcaaccgctctttttccttaaaaagaaaaccatgtacacatattcttcttaatcattatatatgttggaataaacttagaattatgtagcaacattgaattattttgcttttcattaatcttactctctaattttcaaaataatcttatgactgtatatatttaatatcaatattagatttgacctagactattttgttattcaaaatttgttcaatcatttgccaagttataagaataaaatacttattaatacaagcaggtacataaaatgaacatgggcaactacatatcttattaaataaagttattagcacaaattttagtgtggctccagcaagcaaatgatttacagcaggaaagtggaagtaacatgtttgaatttgcacaagtagttctttcaaagtgaattagctagtcttaagacagcacctgtgaggaaagaaaaatattattcaccaccataaacaacacttaagagaatgtaaaatcagttgtgaaggcaatgtcaaaagcattaagaatgttttggtaatggcaacaatatggaaataactgacttgtctctctgttgtagggaatgactttgttggagcaagtgattttctataataccattatcgttactttttcatcatatctcaaatatagctctcatttatttaggggagaaataacagtagaatcatcagtcagttctaacctactaccgcacacgtgccacacattgctaattggtttacttttgtaaggctgattatatctcttccttgattaaaagtcttttgattttctatcaaaataaggtccaagtccttacttttgaattccagactcttcttttctaatcttacctctcatatttttttctgtgtaggtttagaattttctattcctgatgaacatttatttcctcagctgcttatactggttcactccaatcaagatcttcatttttcccatcttgcatatttaaatcctaattaaacactaccaatttctattatgtttcatagctcttaactctgattttaacacagcagtcattgctttctgtactatattactatttttgcccatattctaatcatctccatttcgattatcacttgtaagcaagcaccctgactgctgctggagggaaggccaagagggagaaagagaggagtggagaagaacatgggatcagagagtagagaaagtacagtgtgtttgaaaaattgctagcagtttcaagactggagtgtaggctgcaagttgaatagttgctgaatattatgatagccagaggccagatcctaagggcctttttatatgacatgcacaagttactgttcatttttatactgcctctgaatttctgggttactgattcatgcagacattctgggaggacaaactataaggaagcttataagattgttgacaccagcaaagttctataattaattttaccaattataaaccaaaaagcagtttctgagggtttgattttcaaatcaaattattagttaatagcctgaagtactattattactagcccttacaaaagggcagcagagtcaccggtagaataacttttttcccctagaactgaaatttcgattcttaaacccatgaactgttgctctaagaactttccaaaggagggaagatttaagtttttggttcctcaccagagtaatgaattagcatcactaatagaaaaaagcatattaaatatctcttactgatttgaaagtagatactgtaaaattttttgctgcacttctatgccacgtgatgtttgtcactaaagaattgcatgtactacagtgtctatgccatatagcccagatgtgtagcagtctatataccatctaaggtttgggcatgtcactctatgatgtctgcacaatgatgaaactgattaatgacacacttctcagaatgtattgtcatcgttaagtgacacatggctttacacagagctaatccagatctattaatgatgtccataacagcaattataaacatcataattgagactactagttactaaagttgttaaaaatggttgctattacttcttaaaaagagagaaaatccatgtgacactgatgctcttttcactgtgccaacttcccactggtagcaatcctggaggtacatacatactcaatagacacacggacaagctagatagagtgcactgaatgccataagataaatatggattatattcttggagtatcaattttagctggtgacatgcaatacttttttccacttgaaaaagtaaaatatggaatagaatgcaaaagtcatatcgatatttatgataaaatggagatttccaaaaaattagagaaatcggtgtgacctttatcagttaaagacaagcatttattactgtctactattaggcatactttaatggaaatgtggagtctctcaattcagcatgaattgtatagaactaatacaaattctgtggttatggtacaagttaactctgaaagagccagagcttccaaggtcccctcaaccaccaactaatatttataatggcatataaagccagtcacaatctagccccacacaagcgcttgtctcacatctcacaattcacagtggatttctcatgttccagcctcactgtatgacacacctgtgtggagaagacagcatagcccctttgaagttactgcttggatgattaatgacgatgaagcaacaacaaagccaagacgggcatgtacactaggttaaaatggctaataccctctttgtacccccacccccaggtcttgtttagtcacaatactgtacctttgtatatgccatacctactgtctagaatgcctagttcctcctccttcacaagaagtctgtataaagcctgttttttttttatcgttcccacaactacttcagacatggtagtacttcttgtttttgagcttccatataacttattatagcatttgttgcactgtgtagcaattatttgtttaaagttgatctctctcactcaagtataagcctcttctagagggcagaggaactaacttattcacctgtttcttcatggacctattcaatttcccccctggacacctggagaaagtttttaatgagtttatctttctctttgactcttgagcctgtatcagtccaactttcctctcccactggtctccatagtctaagtattgttcttacttctgactacagtagtgatatgactgtaatagatacatgcggtatgccatggcatataaaaattatttgagcatttataaatttgctgaatgattaattcttcaaatgacacaaactaaaattaaggtaacattttgaactggttattaaacgaattcaataggcaatttcttcttcacttttaatattttactctgtgggcaaacataattgctatcttccattttcagtcaagagtatttataaacctgtaatccaaaagtggaattaaatacatttattaagaatatttaattacatttagaaatttaaaaattatctaaaggcttttttgaaaagttaacatttgactgatgactgaacaacaaataggaaccatgtgaatatttggtggaaaaacagcaatagtacagaccgttcattcaggaataataacaagacaaaaatgatcagaatatagtgcataagggacaaattgtatgaagtaaaactggagtgagaggcagaggtcagtgggaaaatgccatggtgaggagtctgaattttatcgtaattgcaatgagaggcccctggatagtgtcaggatatgatctggtttactttttgaaaagatcactttggctgctctgtagagaatgcatagggagtgctgaggaaagcaataatgagaacagagaaaccaggctcgctctttcagctattaggatttaagtcattactttatgtacatatgcacttattggctttattttggtttaatattttaacacagttgccctgccatttcttttcaaagtatttatgcttaatatgtccagccctattaataacttgtattgctccaatataggtgggttaattttccttcagctcttctccctttatctgctacctgtttttagacttaaaagtaattcagatttgcccatgagtattctgtattctacttctgtttctttttgcttaggacaaaggtaggtaggagagggagagctataccaggtttctggtatctctcagttttattggaagaactgtagcggactcactctatttagtcaagagtatatccttttcctcttgagaggtgctcttgggctttgatggattcttagaatatctcattttcatcagctgtatttatcctgtggctaccaccctccactcaacccagatctccttcacctctctgcagcagcttcccccactctccccaggccctagtgggcaaatatgaaaaaccagcgggagggttcatgtctctgaggcctttggggtgcctctttcacctgggcattccccctctcagatgatctcattcttactattttactggatcttctcttctaatgaagcctagtatgcctaaagataacgttctgggttattttagttagctttcctccctgccaagaaaaaccagaatggcaagccctggttctttttattccttctgattaaaaaaaaaaacaaaacaaaacccatgattggtagggaagaacttgtctcctgagggattttctaggtcttttccctgagctactaattgctccctccatttccatctctccagattgagagaattaggttcagtgttcaggcttttaattagtccccttccttactcttcccttcactgtactgtttccataagcgaatagagagcagccatgccaattcctggaatacgttacctctctctttccctgactgtcatttttcagagattatggttacaattccacgcacagatgtatagattcaattattatgttaggtatagagggtgtcaataggcctgggtaatcaaaaggttagggaaaaaaagacagcaggaaaagtgttggagtaaaacttccataacctttaggaaacgtcacagaaagtgattgttgtaatatatgttacatgctatgttaagtctatgctaagaggtactctatgtcagtagttcgcaacctgggatgcatcttgctaggcccattctacacatacgtagtatcaatggttaagtactatgtggtgccaggcactgttccaagaactttacatacacagagacacatatccatttactcatctcttcagccctacaaaacagaattcagtattatcttcattttatagatgaaatgaatcacagagaagttaaataacatgcccaaggtcatatagctggaaagtaatgaaaccagaattcaaattcagataatctggctactttgcacaggtttcaaaacaatacacctattttctctacacatcaaaaacctatattgctaatttaagctagagctgaaaccaaaatactgaaatacagcctcccagcttctagatcaaacagtgtcattttcattaattctcacttattaaatgcttatctcactcaaaaatcccatacctaggaggtaggtatcatctcaattttaaaaaaatggcttgaaaatgtcaagcaaattggtggcagaaccagcaggggaacctgtgtctttcaacctccaaagccccagttataatgactctattcaactgtttcaatacagaatgttattcctttgtaacatatatctatttcaacctttaagtgatttctattaacctccaaataagctcattctgattgtactgcaataattttcttattctgaattatttgttaaaagttattttaagaaaagtacttagcctaattttacatagagaatgctaaagaataattcttagggcagaaatccatggtcggaatgatttgtgtttgaattaggacatacaggatttgtctaggcatgctgtaatactagttttgtgaaactctggtgtgataaatagctacttttatctaaaccaatgttatttactacactaaaaaaagacaattaaaatcttagccaggaaaactaacacatacattggaactcttcctacattcttttatgttctaacactcagttgctatctctaaacttttggtttgcatatgaaaaccagtaaatcacaacaaacctatattctgaaaaatttatatttagaagagccaatgctttaggaaaaagcattactttataaggtaatatttttctagaaacatacacttacttctgcttttttacgagcttccatagctttcataagcatcatgtgttgtcgccttcgctctcgttcctattaggccagataaaatgtggaaaataactcagccacaattaacagtttgattttccaatgaaaaaacaaaaacaaaaacaaaacaaaaactcagtatagcatgtttagcatttatagacaagtcacagtaaatactaaatataagacaagaatggccagtctgtgcatgttttagttcaggtttagaaagcaaatacaacaatcaaaagcaaaaaggtaaagcaatgaacatggagacagtgtaaacagaagcatacaagatttacttatggtcagttgtgatgctccttcaaaagctggcagaacaaaaagcataatggttggctggaacaggtcagttaccttacatctgctattagaaaaaccacaaatactatggccaattaaactaacggttgtgttgttcttaaaattttagatcaggaagaaattgatttatagtcactttaacttcatgattttagagtaggttattttcagtacaaaatcattttgcaaatccaataagccaccaataaattagagtttttttaaggcttttataccaatttagttaaactagtcttgtttcacatacaccaccaatgaaatgggatattcctatttactgatgtctgccacctgatactctatttaaagccacaaaagctgcaccatgggctcacaggtggaatcttaaaggcacagtatgaaaataaggtaagcactagtttaatttgacattctcactttacttttaaaataaaaaaatcacttatttataatatctcatcgatttttttgtttaagcatatttggtttctccaaagggatatttctaaaattatttctaaaatttgtctatgaaaccagaatatatttcatattctctcatcaaacaaactcaaaattcccactgtattcaatggcagttttgcatctagaatgatgggagaatacgggtcataattatatctaattgtatagtgatccaactttctttgtgacatcagtaatgtaaatttttagagagcagccttatttaaggcttgtacaattcaatgtaaaatcttggagatgcatcatacttctttatagacagacaagcagatgtatgcaatgcactgtgctgtaaagccatgcagcagtatgtaatatgacagcagccagtgctacactttatgcattgctatgacaaccatatcacaaccaaatcacaatgcggtgttagatgtacaaaaataaacatacccataccatatctagtctatgcctctccaactcctggtagaaagagttggcacaacattatgaaacagaaatcacagagtcataaaaccaattttttaaccccccaaaaagacaccaataccaaagcaaggcaataaactgtaggttgaaggaaaaacttaagcagaaattatatcagaaattttaaagaaaatattttgaagattttcccccaaataggtttaagcaatattataaaatgtacattcaacaattgtataactatacatatacagacctgatgtttcagaagaacagcttgttgtcttctcatttctttttccttaaaaataagaaacttttaatacgtgatttttagagaagatttagaacatgctaaaagtattaaaagttccttttctgagattctatagtttttcattaggttgaaccatatgaaatggccaatattcaattattttttatttataaaatgtcaattcgattttgtatgcttctacctaacaaatacttacatagagatcatataatatggtaaatatggtagcaaggatctttcttcagtagtcattttaacttaaaatttaacgaatgactgacctaactgcacacttcaatggcacattcattgaaccaactagctagatggtcagagcctatcagatataacccacacatgtatttttaaatcagtttaatacattatggtgcaaccctcaaatctagctgattagaactctctccattctgaatataaactctcaaatatactctataattaacatcatttttttttcatttctatacactacgtatgaattaaagtgacaaaaactaggcaatcagtgtgaaattttcatgtccacctataattcagggcaccattccaaggggatggggcttaaggcaaaccattctaggaatgtcactgatctcagtatttctatgaagttacaatatggatgaaattaatattaacggcagacatgaaaaggtagaaatttaaaaaataaagtaagacagtctatgtagaaaaaataaacagttccctggctttacaaagtataactgtggtggctgtttccagtaccagtaggctcacccagctaccccctttcagtattcagttactggtggacggcagggtgggggaggggaggaaggggacaactctcctataccccatgccaggaaatcagaacaaaacacccccaaatacatgaagttaaaataattaaaagcagctaattttattattggtaaataacagttgatgaagtttggcttttgtttctgtaggcttttcatttttaatagataaaacagttgctgaatattaacaaagaaaaagttataaaggggagaatcagattgagactcaaatataaacatacctataccatatctagtttatgcctaaacataaacataaacataaacataaataacacacaaaacagttttggggggggtcattcttatctagcaaaactacatacaggtattaagcaacaatttgcatttctgatttgatgtctcctaaacagctcaaagcattacaaaaaaccctgcataataaaataaaaatacacatacaatatacatacaaataaaaacatacactatacacatgtagtatctgctaaacatattttcagatagtcattttgaagaaagctattttttcatataactgatgccagtataacatatagtttttatttttcaaaaataaaaactctgattctcatctaaactaacctttattcgtttctcggcctccaataatttggcatttgccgcttcttccttctttttctttttagcctgtgcatgcaaaacaggtctcaaagtcatgcaacagcaccactacaacttgcaaataatgtcagacttgaaatgaagctacatgtctcacaaggtacgaaacagtatgtaacacatatgtagacaattacagatttccccccagttaacattatgtttaacgtaataattttgtttctaatttatagaatagcattagaatacacaaaaatttcttagagtcataagaatatgacagcttttcttcttcaagctttgttaagtctgaaataattgagtgtttatgttcttttaccttaaaatttaatcacagaaaagtgattttatgtcacattgtttttctgattttaaaagtaaaacataatcactgtaaaacatttagaaaacagaatagattttaattaataaataaaaattatttcaagaattagtaatatttgagaatgaacctgtttatttaaaatttatttttaatacttgaaaatttgagataaagaaattcattattggtttatgtctattaagtgaagcatattaagtctgattttccccatctctgtatagtgtggttaagttcaagtgttttttttttaatagaatgaaaacttgtaatctcatctttcatgaggcacaatctattgagaccatgctatttatcaaacataagcttcataatcttaaaatcattaactgtgtagaagtttcataactagtagttactgtcagtttactttaaaataaaaacattttcaatttccggtttttaaaattaatttgaaatgggtaagaaaaaatgtgtgtgtttctagaaggaataaaactgtaacagagaaaacctcagctatccggagccctcagggaataaactgttctataaagcagcagtttccggaatggtggagaagttgtaataaatttaaacatgaaaagtttattttcactcttttagatggaaataattttgagacatgcctgcttagacacagtacactaaacgtaatttggcgttttcttgatgactcagggcaactattttcaacatcagttatactgcacagctccaaagagtaatgcctttgggctattaaggttttgaaaattgcttgctattcaaataaaagattacaggctgttgctaggcttttcagttcctatatatgctagctgaagttttcctgtattttttctttgctgtcttttgcctattacttttgctgttgccaacagatgtcctctatctctattctaattagccttgcagggaagagggatatgctagaaaccagaaaaacaatctgataaaactttgcacatttaaaatttacttttacttttgaaatcttacttctgtaaacatttgtttctaaactaaaagtaaatatcagactataagccctaatgatttttcttttgttgtttacttttataaaagtaaaacattttagcgcatgaactttatgacaactccactgactgctcagaagttttcctgtttcttttgcctcattttgtatatctttactgttgggattagattagcttgctaaataaggctcagataaagttttattctatgcagaatgtttaaagagaatatctgacaaacaatttgtgtgagaaaacatgcacgcaaaatatttatttttgcagacttaaaaatatatggctaaattactttaattatattaaatttaagacttctacctctagaatttgctgagctcgaagttctttttccattctgatttgctgtattctcttaattttttcctgtaggaaaagttatgataacttgagataataaaataaactatctgagtaaagagtatttgagtggaatcaaataattaaaaatataagtacaggtcaggcgcagtggctcacacctgtaatcccagcactttgggaggccaaggtgggcggatcacaaggtcaggagatcgagaccatcctggctaacacagtgaaacctcgtctctactaaaaatatttaaaaaaaattagcagggcttggtggcgggcacctgtagtcccaactactcgggaggctgaggcaggagaatggcgtgaacccaggaggtggagcttgcagtcagccaagatgtgccactgcactccagcctgggcgacagagcgagactccgtctcaaaataaaaaaaaaaaagtacaaaattaccaaaggatggacataaaaatttcattatttagcgtaaaaccatatatattttcatgtctgaaattaatatgatttgataaggtttctcacagtaatttgtaaaatgcaaatgctaaataaacagaaactcagtgaaccaagctgattaaactatatagcctgaagatctttatagatatttgcagttacaaataatacttaacttgaaataatataggactgaatagcagaaaaatcatgtatcagcagtcagaaaacatacagccaattctggattacagtcatttattgaatggtcttgagcaaataataactattcttctataaaatagtgagaggtgtttgccctttctcatttgtcacaattaaataaaatgctttaaaaagtatatagtgacacaattgtaacattattattaacaataatttccattctaaaatttatttcatatgttgaatagcataatataacattgcttttaattacaattagcccatttcagaaataacctgtaacattattttaaaattaattaattataatttaacattccagggaattatctgtaggacataattggggtacacgttgtctaaatttaatgaactggttattggatatgttttataacttagtgatcatataaattttgataaaaatttatattttaacttaaaaaattatctcatattctataaacacattcttagcaatttcatgttccttaatccgttcaaaagtcccaaattggcactgatgagaataaatacaagttaaaaaagaaaactcaaagtttcctacttgaaaattgtacttatcctagaatttccagtgccaacacctgtatttcacaatgcctgctcccatctccagatgctagttgtacctattgaagctatacattaatatgcattttaatttttttaatgtacactgatgttattgattccctgcaggattctactgcaggatgatgaaattttaggaattactgttttgattttacaagactgatcacattctttgattttggtgatcttatcatggtactgaatattaattgtaggctgtcaaaaataaaaaccccaaagtgggccaagtactgtggctcacacctgtaatcctagcactctgggaggccgaggcgggcagatcacctgaggtcaggagttcgagaaacaaacagtgctaggtggtgaaaccccatctctactaaaaatgcaaaaaattagctgggtgtggtggtgcatgcctataatcccagctacctgggaggctgaggcaggagaattgctggaacccaggaggcggaggctgcagtgagcagagatcgtgccactgaattccagcctgggcaacagagggagactctgtctaaaaaacaaacaaacaaaaaacaaaacaaaacaaaaaacaaaacccaaaaccccaaagtgtatcttttgtgtaatttccaaatcttagaaaagattgatccatatttgaagtatttatttgaattagaacttgatatctgagaaaagtatactcttgatctgacttttctgctcttgtcaattataacattataaggtgctatgttttcaagccagcaaaagtcacttgttgttctcttatgcacagacaggcagggaatcttggggcttacgtacacagtctaaagctttatcttaagtattcaagtgacttttatatatatccatacatatttggtagtgttatcattagcatgcagataaacatggtaaattattataatacaggttaactttgtaatgttgagtactcagccactgagccggtcactttacatttaatatcttgtcaatcattaaaaaatcataaaagcttaaattatcttctttttacataagagaaaactgaggttctcagaaagtaaatattttgtctaaagtccaatacttagtaaatatagagtcctcgtcagatcccaatgcctgtgtgcctcctgctttgtaataatgtttctgaaattttccagaaaattgtcttaaggactatctggtgatatttttggtctactaggtggaaaaaataatccaaaggatgaaaacacatgtactattttattctagatcaaatgctgactttaaaatagaccctatataacagagagtatgagtagaattactctatactttgattcactttgttgaatcaaataaatgagatggtattctgagattggcctcagataaatatcttgataaatattaagaccagttcatttgcattaatattgctggaaactttggagctcaatgctttttcaatgagtagcaaagaccatgtggattcaggttgtagctactgtaagactttaggatcataaagctgaattaaaagtactgatgggatctaatgagtctccagccattagtaaatagaataagctataaaactttttcaataaaagtataacagaaacaacagtatttcacttaaaaatgaaatatgaacttattttttcatatatactctttagtaaatatattttaacgaatgcattcactagcctatttcaggtcaatcttacaatgtctagcagtcacaattaacaaactaaggatggaattcaagttgacaactgctactttaaattatggtggtaaaagagtacactgtgtagttggatgttttatatttatctttaaaaagttgagcatgtgttttgttgccagtcactgcagtaggcactttatgttcattatctcatttattcagatattgcagttaacttcttttatgatggaagaaataaagacttaagggttaagccattcatctaaggtcacaaaattattaagtagcagagcccatatttaactgtaggctgactgactacaaacttaaatcctaaatcccaactctatatcaacttctctagtcatattgctttagttaatactggaagaaaccttggagataaccacatcaaatccaacccaagccatttatttagcaggtatttatatagtaacataattgatttcatttcattctcagaaataactacatgcttcctaatatttttaaaagaatagtactttctccccatttcctttctgctttaatgttaccatgaatatgaggagatgggagagtagtttacacattctcatcttaaatgaagctgaataccttctcacttaatttttacctatgaaaatttaaaaattacttctcttacctaaacttaattttgaaaatcacatggggagaaatattgtagatacaagacagagaactctggatttgctaaaataatgctgtcatcatttttttttttttttttgcagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgttcaagatatcaacttatacaaagtctaccaggatattaaagtacttacacaaatttactgtttggtaatcatttctttaaacacttggaagtagaagactttattaaaaaggtaaaattttaattaatagaagatagcaactttctaaataagacacaaatattaatgtgaaatatagttatttaagaaatcaaaaataatgtacattactaacaaatcctcaaaataagtcccatattttaaaagtcacttccaatgtatacacatacctgctgtttcataatctttatctgttctttttgcttccgcttctcctcagcagccattattgctacaagaaaccaaaggatagatatcatcaaaaagggaatgaagaaaagaaaactcttatgaattccccagtactgactcttcgagtttatgttacatttaaatcactcaccttgttgttttttggcttctttagcaacccgagcctgttcctgcttttgaagttttctcaaaagctttatttgtgctgcttgcctggctatttctgaaaaacacaaaatttcaaagaatattaacaactttgtgtaactactaaccaaaaacaataactgtgtgaaaatggtatcatcataaaggatataattattacttttttttttgagatgaagtctcgctctgttgcccaggctggagtgcagtggtgcgatcgcggctcactgcaatctccgcctcccaggttcaagtgattctcctgcctcagcctcccaagtagctgggattacaggcgtgcgccaccacacccagctaatttttgtatttttagtagagatggggtttcaccatgttgaccaggatggtctccatctcctgacctcatgatctgccccgcctcggcctcccaaagtgctgggattacaggtgtgagccaccactcccagccgaggatataatatttaagaaaattgcctaaggtcagacagataccaagtagaagagtggtgtggtagacaacgtcatgttcattccaacggaaactgaatgttcattccaatggaaataatcaaattatttcatcaaatatgatcccatatctaggactacataaaaatgaggtttcttttaatctttatcagagaggcttatttaagtacattttttttcacatttcaagtaaaccccacttagtgggaaaatagctgctaatattttaagacttgtaatgtagcttcagtcttaacatataaaaaaaaaagaaagactctcaattaaaacaaatacaaagtcccctcccacccaaacttagtatttcaattagctataatggttaagttcctgaatccagtgatattttcatttatgaaggagagggactaaatctcctaaataaaaagaaagcagaatttcaatgacttttaaagacaacctagttcttataatcttcaaggatacatgtatgaaactagggtagatgaacaaagttaatgtccccaattcttcatttctccttttatccatgacatttgtaatgtgactttggagcaattcccatcaagaggtggaatatattttcccgtcccttgattctgaactcaaccatgtgattttccatggctaagaggatgttagcagttgtgatgaaaacagagcttgaaagtttagttgtattctttcggcttttgttcttgtgctttgcccaagactgaagatatgatttgggggctaggctattgggagattgggacacagggagcagttgaccctacaaatgtgaacaagcccagccaagataagcaaagctgcttagctaatttccagctgattccatgtgcacaagtgattaagacagtgttgtgtgctactaaggtttggtggttgttaccaagcattactgtggcaaagggtgtaacagacacagaaaccatgtaatatccttgctttcttctgctggcaaacttggtctgaatacttcaaactctaaaagtggtatataatattactcatataatcattttagaaagcatcactttgtattatacattgtttaaattttgtagccactgaacaaagaaacctaaattatgttcattgacaaggaacataattgctaacacgtgaatcacttgagctctaaaaatttccaccatttattgatcgcaggcactattgtgttaaatttttctttttctttcttttctttttttttgaaacggagtcttgctctgttcccaggctggagtgcagtggcgtgatctcggctcactgcaagctccacctcccaggtttacgccattctcctgcctcagcctcccgagcagctgggactacaggcgcccgccaccacgcccagctaattttttatacttttagtagagacggggtttcaccgtgttagacaggatggtctcgatctcctgacctcgtgattcacctgcctcggcctcccaaagtgctgggattacaggcgtgagccagcgtgcccggcctgttgtgttaaatttacaccaccttgtttaatgttcacagctacttaataagatcaacatgattgccccgcttacacaaaaaataactaaggctcctagaggttaaatagcatagccaagaaaaaaacccacaactggctgggcacagtggctcatgcctgtaatcccagcactttgggaggctgaggtaggtggatcacttgaggtcaggacttcgagaccagcctggccaacatatgaagcccccacccctactaaaaatacaaaaattagccaggcgtggtggtgggcacctgtcatcccagttacttgggaggttgaagcagaagaactgcttgatcccgggaggaagaggttgcagtgagctgagattgcaccactgcactccagtgagactctgtctcaaaaaaacccccaaagaaaccccaggactttctgactccacagtctatatgccactatttctaaaaatctttaagcaaagtttaaatgccttaagattttagctaagaacgtaaccatatgtcctcataacagctgaagtgaagttggtcactatggccagttttctatcactgagacttttaaaaaggagaagagattaaaaaagtcgaatttcatctagtaaactggaagtgttaatgaaaaataaaatggaagatgatgataaagtattatctccaatgtcccaaccattttcaatattaggaggttacaggcatcatcaaaaatttctgggtcacacaaaaaagatgtcctgttcactaaatactctaggacataaaaacctataaactgaccttcagggtcagcaacctctgataataatatgggtgaagaatattattctcatctataataatgccagataaatatttctttaacattaagaattgaaagttttgaattctacaatagaggcctgactttgtcttgaaatgtaaagatgtgctgataaaaatgtttcctagaaaatatggcataagtacgatcttttgctgcaagctaaactgatattctctaatataagtttaacttttaataagaaaattctataatatatatagaaccatgtttgtgtatgagcgtatcaatcaatttcaagccctacacaagtacacagtaatttttgtttatttgtttgagacaaggtcttattctgtgacccaggtgaagtggtatgatcatagcttgctgtagcctccaactcctgggctcaagtgatcctctcccctcagcctcctgaataaccaggactataggagtgcaccactttacccagctaattttttaaaaatttctttttgtggtcttgctttatttcccgggctggtattgaactcctggcttcaagcaatcctctcaccttggcctcccaaagtgctaggattacacaggtataagccactgtgtctggccagtaatttaaaaaaatatttgggccaaaaaaatttaaaagttcaactcacatctttttactttagcaagaaatataaaattttaactaatcattaaaaatttacatagattaaattttacattatgggcagttggaaaagaagatgatgtgaaaaaaagaaaaaggccgggcgcagcagctcacgtctgtaatcccagcactttgggaggccaagacagatggatcacctgaggtcaggagttcgaggccaccctggccaacatggtgaaaaccgaactctactaaaaatagcaaaaattagccgggcgttgtggtgggtgcctgtaatcccagctactcaggaggctgaggcaggagaatcgctgaacgcaggaggcagaggttgcagtgagctgagatcgcgccattgcacttcagcctgggcaacaagagtgaaactctatctcaaaataaaaataaagaaaaaagaagaagaaaaaaagagaatacagaggagagagaatgagttagatacctagaaaagttcacccaagctgtagaaataaattacttccagtatcttctcatttatttgttttttttttggttggtgaatatattataattaccttttgaaatactaatttggaaagtatcttttgtggcttaagaaactgtctgctttaatttcaaagatgaagtttattttcagatagaattagagatattttggatataactcatttctttgatcctaagatgcatttttaaacattttgacatctctaaggtcagaatgtaactgataactggcagctcttttctttcttagtgtacatcttaaaataacggtgcatggtatagattacttataggcatctcagtttcaatcgcatatgaaatgaataggtgctacttcatattttggaaaatttgagatattaatagtatcagtcaatcaacaagcaggtttatttatatagaatgaaagtctttatcatattcaaacttggtcagatttttacctatattctgagaaattagagttctcatttcacaacgtttggatgtacattcaaaactcacatttatctcactattctgaaactttcttcaaattaagtctggtttttcagtctagttggtcatagaaggataataatatacaacaaaaacttcttctagaatcctctcagataaccccccaaagtgttaccaaagaaggcttttagaaatgaaaaaggtgataaactgtttcatttttactttcttttcttcacaggaaaaaatgcaaacaatactccatacacttgtaaatattaatagattatttacttactgttaaataatctttatatacatgttgagaaagagtacatgtaatatacaataaggtcaaaggtaacagaacttgcaaaatgcaatccaatgtattataacaagggtaaactatgtaattgaatacaaatcaatttgaaatctggagggagaataaacattcggtaaaagttgaataattaacttctactttgttacaacaaaaatatagttaattttctaaatttaaatttgctattttagattctaacttctaatgataattagatacggcaaatatccatgaagatcccatgttttgattatcagttaatttcaaactttcttattttatgcaaacaatgtccacattccccagcattaaacattattcagaagggtcaatagcttactgacaatatcagtttttaaaacccatctatgcctgttaatttattgactttttaaccttcactagtaactctttgggatgaaagtcttataagaagccaaataaaataaaaaaatctgactaccatactgatatggtttggctctgtgttcgtacccaaatctcatctcaaactgtaatccccacgtgtcaaaggagggacctggtgggtggggattggatcatgagggggtttccccccatgctgttctcatgatagtaagtgagttctcatgagatctgctagttttcgaagtggtggattcccttgctctctctctcttctgggtgccttgtgaagaaggtggctgcttccccttccaccatgagtgtaagttccctgaggcctccccagccatgcgaaactgtgagtcaattaaacttcttcctttataaattacccagtctcgggtcataactttatagcagtgtgagaatagactaatacacatactaagataaaaaatttatatgataactgctaggcagttaagctattagtcaaagtatgaactggagacaatatttgcctgctatccataaaaacttgaaaatgatttgtgtaatatgtttagatttgtataatatatgcttagaaaagtgtaatatatatttattataattgtatgatagtgaagatctagaagtagcttaaatagtcatcaaaaagagactgactcaagtccacttattttaaaaatcaaaaaggatatatatgtatatgtgagtggttgcatgtgtgtgtatgtgtgtacatatttctggaaagattaattattccactgataacaatgagaatgtcttttatttatttctttagagacagggtctcactctgtcagccaggctgaagcgcagtggcatgatcatagctcactgtaaccttgaattcctgggctcagaggatcctcccacatcagcctccacaatagctaagattagaggagtgtgccactacacctggctaattttaaaattttatttgtagagatggggtcttgcttcattgcccaggctggtcttaaattcctggcctcaaacaatcctcccaccttggcatcccaaagcattaagattacatgtgtctttaaagcattctattctatgagttttgtcatagatatttgttttataataaaaaacaaagcagcaacagagaagtctatattatgatggtgtttacaatgaatagaattaagtcttttatacatttcctccacattttgcttatttatagggataataaaaaacccatgagaagtagtaaaattctgttagatttttaagtcaattttcattattaaacctttattttacattgttacatatctttatatatatgccttgcaaatataaggtatctacacatatgttgatatattcagacagtcttaagcggcttcacatttgtaactagtgactcaaactgcaaagccaaactgttctattttactcagccttctctttgccatacatagcatgggactttcatgttgacattttatgtataatgtcaaatcattaatacagtttaggttattatcagcactttgagcttgataaatgataatttctggttatcttaaagtactttttgattttaatgtattaatttgttattctgaaaatatatatactatatctggactacaggagaacccaaactaaaagactggggttacttaccagtaattggagttctctgactgaaaatttactccacagatccacatattttggagttattcccatgtaccacctcaaggaatcgggagctgttaaaatgagaatttccagaaggttggcacgaccttaaggcatgtgccaagtgctggttgattccctttctgtgcaagccttaaaagcttaacacccacctttgtaattctaaatacacaggataggatgtgtttatgagtaatggttcttgaaagattacctaatcaaagaactccagttaccagtgggactccttattttttcattttattctaacacaactatttactttttaaaaattgagagcagtgtcaatcctaagtcaaaaatattagaaatacttttagtatactttttagtatgattattagtgtcagacacattatgtttcttaccttgagcttgcagttttcttagcaactttgcatctgcgttatctaggaattcagcattgccaacatttggaggtcgacctttccgacgtctcatcctggattcctctcttgctcgttgtctatctggatttggtggtcttcctctacgaccttccattgccctgatacgaggaatgacatcctcttctttcaaaagacaccactgcattcccttttaattaacattttatagaaataatatattacaaacaaaataaacacaagagatcaacatgtaagaaaattctagctaaaaatcacatatattttggaatttacaacattagtataagctttaggaatttcatttttaaattaaacttagatgtataattattcatggcctttggcatagctttaatattcttactttaatgacttaagctttaattaaatatatagatttgtatctgtatctataaatgtagagatataaatcttaatcaccatttctgaactataatgaccatcgagttagcagatatttaaaaatgttagttgtacaatgatgccactatagattgctcttatgggttatcagttaaaccaaaacactaagctacccaaataatacatgaaagtttctctttataaatattacagctaacaaattaagacagaaagagttagaatatcaggattctgcaatacctaataaattagttaattgaagaattgaacttgaatggttgcctatcatcaaaaagagacacaactagacaggtatcagcctcctgatggaggctcatacaatcacctataaaatagtactgcccctcacacacacacaaaaatcaaacctggatttgatcaagcctctagatttaattacaataactttaaaagaaacacggaagtataagttaaactatacggcaaaatccattctgtgggaaattctataaatgacctagtttcttcaacaaatgttgcaagaagtaagaaaactgtaggaagtttaactgaaccttaaaatatgtatcaaacaagcccaatttgtggaccttacttggatacttatttaaatagacaaactggctgggcgcggactggccgggcacagtggctcacgacctgtaatcccagcactttgggaggccgaggcaggcagatcacctgaggtcaggagttcgagaccagcctggccaacatggtgaaaccccgtctctactaaaaatacaaaaatcagctgggtgtggtgacaggcacctgtaatcccagctactcgggaggatgaggcaggagaattgtttgaaccagggaggtggaggttgcagtaagccgagatcgcaccattgcactccagcctgcaggataagagcgagacttcatctctaaataaataaataaataaatagataaactgttaagaaaatttgaacaataaagagacaactgaaaatctgagcaatgactgagagttgatgatatcaagaacgtatcaatgtaaataagtacaaccactatggagaacagttcggaggtcgctcaaaaaactaaaaatagagctaccatataattcagcaattccactgctctgtatatatctaaaagaaaggaaatgaatatactgaagaggtgtctgcactcccatgtttgctgcagcactgttcacaatagccaagatttagaggtaacccatatgtcagatggataaagaaaatgtggtaaacatacactacacaatggagtacttattcagccataaagaaaaatgagatcctttcatttgcaacaacatcatggatggaactagagaatatcacgttaagtgaaataagcctggcccagaaaggtaagttttgcatgttctcacttatttgtgggagccaaaaattaaaacaattgaactcaacagagatagagagcagaatgatagttaccagaggctgggaaggatagtgagaggagaggggcaagggagtgaagatggttaatagttataaaaaatatgtgggtaaaataaataagatctagtatttgatagcacaacatggtgactacaatcaacaataatttatcatacatttaaaaaaacctaaaagagtataactggattgtttgtaacacaaagaaaggataaatgcttgaggtgatgaataccccatttactctgatgttattattttgcactgtatgcctgtatcaaaatatctcatgtggccgggcgcggtggcccacgcctgtaatctcagcatgttgggaggctgaggcgggtggatctcctgaggtcaggagtttgagaacagcctggccaacatggtgaaaccccgtctctactaaaaacacaaaaattagctgggcacggtggcgggtgcctgtagtgctagctacttgggagggtgagacaggagaatggcttgaactcgggaggcggaggttgcagtgagccgagatggaaccactgtactccagcctgggtgacagagcgagactccacctcaaaaaaaaaaaaatattctcatgtaccccatatatatatacctattatgtactcacaacaatgaaaaaaattaaaaagaaattatatattaaaagtataatagtggtactgtggttatgagtccttatcttttagagacacaaatggaaccattccttcaacaaattttggaagggagaagtagatgagggtatatgtaaaacagtattggtcaaaatgataattcctaaaacttatgatgggtacaaggtctatattatcagtccatctatttctgtatatatttgagatttctcatcataagcctcctagtggaggcacatgccaacacaatgctagtgtatctgcggccgggctcagtggctcatgcctataacaccagcactttgggaggctaaggcgggcagatcaaaaggtcaggagttcaagaccagcctggccaatacagtgaaaccccgtctctactaaaaatacaaaaattagccgggcgtggtggtgtgcacctgtagtcccagctacttgggaggctgaggcagaagaattgcttgaacccagggggtggaggttgcagtgagccaagattgcgccactgcactccagcctgggcgacagaacaagactccgtctcaaaaaaaaaaaaaaaaatactgcttagcacataaatacatgtatcctgcatgtgtcaatcaaaacaaatacactgttatattaccttatagtccaaaataatatgttcagatataggagacatcttttaaaaataattgtcttattatttctttttaagagttaattccttcagtatgaaggttaaggaaatttttaaaacgtgtttttctctaaaaatatcctcaaagtagaaattttggttgagtcactagaagaaactgtgcaaccaaaaataacccaaagttcttgagttttacgttataacatgatttgcctaacctggggcaagaagtctatgaatatcgcagttaatgggtactaaattgtacgtgattatggataatagctacatctcacattctaagtattgtgctttgttccagatactttgaatagactatacactttaatcttcacaacatttctatctcatatggtgggttttatcgtctttacaattgaggaaattcaggctgagtgaggttgaatagacagcaaagaacagactgtgattcaaacccatgactgtctcactctaaaacctgtgctcctgaccactatgggtacttgatgttataaagatgttcttatacctgataagtgacagatcataacatttagccatgaaagcacagccaagattatgtcaagaaaagaccgtcagaaaaaaactaatgcatatgttcatatatacatatgctaaaaataacatctatactaactcctttcagtaattcttatcttaaagataattttaaaaattaattctgaggaaaatgaaaattttttgctgagattccaaataaagtcaataggaacaatagttgtacaaagtgtacttttaggccataagccactaaaaaggaagatatcagcatagttttatgtcaggttatgttcaccagcatgggaagcttttgattagtttaggttttcatttttttattatgttcttaagcaccaaggcagcatgtatcatataacttgtaaaatataaaggtaacattcatgatacttggaagagaagagtgactactaaaagtctgtaaacaaatctgcatttggtttttaaagtatcttattaataacaaaatcaatttttggccaaaattttaagagttctgtcaacttttcttatccaatttttacatagttacatttttattcagctaggaaaatacacctgtgtcaaaagaggaacaaaatatgttggtgcctagaacttagcagacaaatatagtgaccatatcattcacatttttgcccttggcatttaaaaagtaaatactttctaaagggattgcatatactggattatgtataatgtcttctgaatcttagattttagaaaatgagaaaagaatcattaggaaaatctgaaacttatacaacagctttaattcattgaagagccaaaataattgtgggtgagaacaagtagtatttttctcaataaatttttcctcaggaaaagcaaatacaatttacatcatttgattcacatgccattggctttttatctatcagaagttatatatcaaaagaatttaattcttttttcttgatttctaagacttaaaatagtaaatatttgctgaaaataatttttgttgactaagatttttaaaatatggataagaaaagatgatcaacaagatggagatagcaaaagattaggtttttttttttgtttttttttttttgagctgaagtctcactctgtggcctaagctgtagtgtagtggtgcaatctcagctcactgcaacctctgcctcttgagttcaagtgattctcctgcctcagcctcccaagtagctgggattacaggcgcttgccaccatacccggctaatttttgtatttttagtacagacagggtttcgccatgttggccaggctggtcttgaactcctgacctcaggtgatccacccgccttggcctcccaaagtgtttggattacatgcgtgcgccaccaagcctggacaagattatgttaattatattattctaattctgctttcgagagttgctaatttgtattcttagtgaataataccttcacttctataaatactacaaagagaaaaaaggaaaaaaagaaaagggtttacgttttatttcagaagactgaataatccaggtaaataaggtaatgaaataagtgaaagtacactgtaaatctgtaatatattataaaaatgaagttttcactacttaaatatttgttgaggcacctttactctgagcaaggcataacattatctaaaagtcagctagagagagaccttttccctaaaggaccacatttttaacaaggacctcaggctcagtcaattctaaggcaggtgaccctaggaccacaccctcagtaatgcattagaaaaagagtttagagcttgggagagaaagttgtctcaactgtccatataaaaattatgatggcctggattagagcacaggaattagagctagaaagagagatgaatagtacattagtcttttgggagagagaactggctgaaattgaacaccgcctggatgtgaaggaggaaagcctgaatgtagaccagaaaggcagttaaggtttggagtagtctctaaagaacatggaaaagggaattaagtggcaatgatgttttcttactgaacaaataaggatggagaaatatttgagaaaactggaaaacaaatttattgctcaacttttttatgacttataaacagacttttaaagaaagaaaatatttctttttagtgagttcttaaatattttctgtattcagaaattcaaaagagatcatgaaatttattttcaatatgatcttcctatttcaacatttctgttatatagtcttcataaataaatgactccaaaggataggtgaacccttcatgagggactggtttgttttcaccttatcttatagacagtaaattgcccaattaactgggtttcccacatttcactgaaagctagggtaaatatgtggtttagcagccacatgtttaggtcttaatgggatgtgttctcaagtcttattcctgattcaattttactcatcctggcttgactttttcttttgttgctcccattttttaaatacttgtaagctgatttttttttttgggaaaagcagtatataattatgtaaatacagtataccagtccaccaaaagctgattagctgaatgatttatttgctaagttattgatgactatttttaaagttttagtatcaccaagactgggatgcagcaatttcacatggatttacagtcctgtgccactagatgcccagcttcccaagttaacatttgagatgcctagtactgtccttcttgaatgctcaatgttatgtaagtgaatggaaggactttgctcttctcatatttttctggactgagacctctatctatcccagtccttgcctctggtagtaaaatatttgtggggtatgttttaaatctggattaaggcaattggtctgacaatttaaggcctattagtcatttggtagattgatcatttaccaaattgatttctggttaaataattttcagtaaatttaaccatagcgtaagtaaacaaagttaattttttcctacctttccttttgaaattgtactttcagaatcttttacttcccaatttgtttatatgaaacttttagaatgtcacacctaaaagcaaattgatcttaaagacctcttatatgcatttacattacagatgagagaattaagttagcttcagtgtaagtaatgtaagatatgaaattacccttctagaactaaaaaaattcttcgggaatgagcaaagaaagggtatcagatatttgcgacgaaatttgacaattcacataaaaaaattaacatcatgagaaaaaaatcaaaattttgttggatttccttatgccttttcaatttagtattatgtctatttctagctacttaatagtgccagaggtaggcagtgaaagggtgatagattatcaactttatgacagatattcttaagtcacactagtcatatagcttattataccatacactacatagcactttaaagatgtgaaagagtaagaaccatgagaaaaggtgtcatctattaaaaacaagtgagaaagatgtggtttgatacaactgtttccacaatgctgactatgctttctacttactcaaagtatgtcatcctctaatagtcaacgactttcaatatctcctccttctatatccttggattcacacagttgtcctcctagtataggcctcgcctagccacaaaaatcctacctggtagattagtgacataaatttccggacttatagatttctggtactgatctttcatgttctcagtgtccattcgtgcccacggctatgttgcattaggtgtgacagttaacagcagagctgaattagaactctggttgttgacttccaatcttttgttcttcacttaattcgaaataattaccagcattataattgtgccagaaactgtgtgttgcccaccttactgtgaagcctcctcttactccttattaacaaaaccctaatttttagctgggcagcattgtgcctactgttttatcttcctcagagaataagcttctctaaaccaacaatcatttttttgtattcttcagtttctctatgaacattagtttttcttcaaattcaggctttcaacttcatttctgtactgaaaggtgtgttcacaatttgctctatgggaaaatgcctttaggggacatctacttacagaaaaaactgcctggcacattaagtatttgccacacatatttactgattaaatgactcagaaaaaaaggctcttttcattaagaactgtagacattttactttttatggcttatgcattaaaaagaagaaacactgtacttttttctaaatgcaacatctcgaagaaaaaaagcaacattttcagagtcattttaaacttgcttcttctttgcatctttcaattttatgctttttttgggcctggtaacagtagatattccatactctaatggttctaaacctcctggttgaaagaaataaacttaaggtctttatgcttagatgtatagctttctacaattcacaaaaaatgcttttcaaggtagatcatcatatatttcaaaataatacgttattaacaatttattttgacgccttcctctagtcctaagaaatatgtaaatacctcttaccttagtgttatatttaggtaaataaaaataatgctattttattaccaaaatatgtctagctcaaccttatcttcttttattctgacaatcaaacacaaagtaaaataaaaacaatgccatttattcaacaatttttttataatgtgatgaaacagaagtccgtaggaaatttatttaccttacaccattttcaaaggtgtttcttaaactgctaacagaaattcattaaaaggtagccagccagtacagcataggcttatatagagtattacaattgttttgttccatgaagtctatcactcctctaaaatcaagatttttacagaagctggtaagaagtgtttgaaaactatcaatatgctgaaaagtagccgatgctacaaattcctcactacatctgtggaccaaaataaataaaactgataatggatatattaagtgtatcttataccctatttctttctttacatttttttttttttaattagagacagggtctcaatctgtcacctaggctggagtacaatggcatgatcatagttctctgtagtctcaaactcgtgggctaaagcagtccttccacctcagcctcccagggaggtgggactacaggcatgcagcaccatgcccaggtaatatttttattttttgtggagatggagtcttgatacattgctcaggctagtcttgaactcccggacttaagcaatcctcctgtcttggcctcccaaagtgttgggattacaggtatgagccactgtgctgggccttttatccccgtttcatttgtaatcctattttcttgaattaagggcatctccttttttaaaggtaataattacattgttgtccttcagtaaatgataaatttatctaaattttaataaatataagctcacacacctctcatcttattgtactatacaaaagttaatattttcaacaattgcttgctgttaatattaataaatacatatataatcatatcttaagcccagaaatatcttgaatcaaaaaatgattaagcaaaatatccacggtattcaacaagaaaaaataaaaggcatccaaataggaagagaggaaatcaaactatctgtcttaagagacaatatgattctatacctagaaaaccctaaagactttcacaaaaggcttctaggactgataaacgagttcagtaaagtttgacaataaaaaatcaatatacaaaaatcaataacatttctatacgccaatagcatccaagctgagagccaaatcaagaacgcaatctcatttacaataatagccacaaaaagaataaaatacctaggaatatagctatccaaggaggtgaaagatctctacaacaaaaattacaaaacactgctgaaagcaatcagagaagacaaaaagaaatggaaaaacgttccatgctcatggataggaagaatcaatattgtcaaaatggccatattgcccaaagtaatttacagattcaatgcttattcctatcaaaccatcaacgtaatgtttcacagaaacagaaaaaactattctaaaattcatatgaaacctaaagagcctaaattgccaaagcaatctaagctaaaagaacaaagctggaggcatcacacttacctgacttccaactatactacaaggctacagtaaccaaaacagcatggtactggtacaaaaacagacacacagaccaatggaacaggacagagaactcagaaataagactgcacatccatgaccacctgatttttgacaaagtcaacaataacaagcaatggagaaagaaatcccctattcaataaatagttctgggataactggctagacatatgcagaatattgaaactggacctcttcctttcaccatatacaaaaattaactctacatgtattaaagacttaaattcctaggaacaaacctaggaaataccattctgaacatcagccttggcaaagaatttattactaagtccctaaaagcaactgcaaaaaaaataaaaattgacaagtgagacctaattaaactagagcttctgtacagcaaaagaaactatcacagacaacctacagaatgggagcaaatattcacaaactatatatctgacaaaggtgcaatatctagactctgtaagaaacttaattcaacaaacaaaaaataaccccattaaaaaatggacatgaacaaacactcctgaaaaaaagatacatggagccaacaaatatacacagaaatgctcaacacccttaatcattaaagaaatgcaaatcaaaaccacaatgaaatactatctcattctgacactagtcagaatggctattgttggccgggtgtggtggctcacacctgtaatctcagcactttgggaggccaaggcaggcagatcatgaggtcaggagattgagaccatcctggctaacacggtgaaaccctgtctctactgaaaacacaaaaaaattagctgggcgcggtggcaggcgtctgtagtcccagctactcaggaggctgaggcaggagaatggtgtgaacctgggaggcggggcttgcagtgagccgagatggcaccactgcactccagcctgggtgacagagcaagactctatctaaacaaacaaacaaacaaaagaatggctattattaaaatgtcaaaaaacaatagttgttggcaaggttgcaaagaaaagggaacactttatacactgctagtaggaatgtcaattagtttagccactgtggaaaggcaatgtggagattcctcaaagaacttaaaaacagaactaccattagacccagcaatcccactactgggtatatacccaaaggaaaataaattgttctaccaaaaagacacatgccctcacatgttcattgcagcattattcacaatagcaaagacatggaatcaacctatatgcccatcaacagtggactgaataaagaaaatggtatatatacacccaggaatactatgcagccatagaaagaatgatatcttatcctttgtaacaacatggatgcatatggaagccatcacctaagtgagataatgcaggaacagaaaactaaatatcacatgttctcacaagcgagagctaaacattgaatatccacaaacacaaagatgtgaacagtagacactggagactacttgagcggggaaagtggtggcgggggatggggctgaaggttgaaaaactaccaatcgggtactgtgctccaggatcatttgcacactgaacctcagtgatgcacagcttgcccgcttagcaaacctgtacacgtacccctgagcctacaataaaagttgagagaaaaataaataaagcactgtgtccctaaaaaaagcatcaaactacatgcttaaaaacgatttcattttattgcatgtaaatatgccacaataacattactttttaaagaaaaaagttttttcaattatgggctttttttctttaaaaataatattagcaacaaagaaattcttaaacataagaaaaattaaagattttatcttttctgaaataaaatactgataggctgttgcttctctttcagatttatcacaggttgctgtatagactttgggggtgaggggacttgtttttgttttcaattagcttttttacttctttagtatttaatgttgagctgaatggccttttatgtaaattatactactggaaggaataaatcattatctcaataaactagagaaaaacccagaattctgcaatgcaggtattatcttctagcagaaagtattatctcctaaattttatatataatatatggagaactggaattctgctgatgcaatttttgttatgtgttaagtaaaattagaacatatagaactaacgttgggggttttgggatatgttttaagattaaaaaatgatgaaaaaaatatacttcccaggaaaatgttttaataggagagtgattaagaatagagctgtcccttagtatccaggacctccctctatgaataccagtatctgcagatattcaagtccctgaataaaaataacacagtattggcatataacctatacctatactcctatatactttaaatcatcaccagattacttataatagtaaacacaatgtaaatgttatgcaaatagttgttacatcatattgtttagaaaataatgacaaggaaaaatgtctgtacatgttgactacagatacatttttttttcctgagaattttcaatccacaattgcttcaatccgcaaatgcagaaaacacagatatggagggctgactgtactaatgaatccacaaatacagcatttcatttgctatcaaacatcacaatagatacatgaagcttggaaaactgtagtggcaacatttaagatcattttgtacaatctccatgcatttggaaaactatgaattctcagttttattgaattacaaagaataggggtatttagttttaaaagacaggaaattgtttttctgttgttgtttttttagatggagtctcactctgtcgcccaggctggagtgcagtggcctgatctcggctcactgcaacctccacctcccaggttcaagcaattctccctgcctcagcctcctgagtagctggactacaggtgcccaccaccatgcccagctaatttttgtatttttagtagagaaggggttttgccatgttggctaggctggtcttgaactccggagctcaagtgatccgcctgcctcagcctcccaaagtgctggggttacaggcgtgagccacaatgcccggcctgtttttcacattatatacataaaacaagcaaattttagaaaagacacaacatgcaaaaaatgtagaaagcaaaaaaaatcctttgttatcaccattacatccatcattagttttgacacatttccttctagtcttttaatatccagttttttaaacatgtttcatcatcaaaccacttacacaatttgcataaaagcagatatattgtaaatacgtatgatcatcactgcatggtagcagtagctttgtgtcacactatattttacatcttctacaaaatttagggtgatcaaaattatttcacatcataattactataacaaaattatataatcttggttttcagagaacattcttatataatgatatacatttccagttaaccatatgcttaaacctattaatcacacaatccagtatataaaaatgtacatggttttataactatatgcatctctaattaattaactagaacacttttttggatgacttacctttaattgttgttttctaaaagtatcctgaattcctgtgtactaattttggttttagctaaaagaaatgctctcaaaattacgaatgttttcccctagcattctgctgaaatgttggcagcttaacatatttggctttagtaattcatcctatttccttgattggaattgatctcaacaagacagtatgcatttggaaaacactgattatatttaataaaaagtgaatgcatgtcaaggaacattctactctgtgtaatgaggctttatagattaggtctaattatcactgatataaaactaaaaatcctttatatgctaaatagcaattagctttcctctccgaacaaaaatctagtgaacttaaaatcacaaagacatctttggcataaataatacaagtaagaatctgataacatgaaacaaagacttttaaaacgattaaagtttctaatatgttttatgactttaaaactgatatcgtgtatacagaatgtgtaacactgtggttcactaaaattctaagaatctggtgacagatttagtctaagtcaaaatctttagtttttaaaaaaatagaaaaccctagaatatatttccatatatttctataaatctcagataaacccattttgacattttagaactaccaataaagagacaggtagatctggacataacttctttctttaaaagtcatggactacaatagaaaataggttacatgatgtatgcaaaagattactttttcagaaaccttgagttctagttatgtctcagccttgtgtgtgaccttaaaaaattcctttaagcttccaaactcaaaataaacctcttacagaatgagggagaccttttccatttcaaaattataaaattaaagggtaagataggatagaaaagctccctattcacaaagaaaatattaattgccaaaaaacttttctatgcattataatgggacagaagagagagaggttcaaggaagaaggaaaatatcaacttcagctggctgagcattttagccttttgaaacatttttatgcatatgatctcattttaatcttgccataatcctatgagacaagaagtgtaattataatcgtttctatttggcagataacaaagtggatggaaaagggggcattattttgttattgttcagaattacaagagtatttcacggattaacaagaatctaggtctcatcactccttaactgggacccctttcaatgcagctaaagggaataataagcacatgcagctgaatacaactaaggaacaaagggaaagcattaaagaaaacatacaggaaatgagatctccttggtgggttctttttgctgactggtgaggatgtgtacttaacactgtaagctcaaagggagctgtggtgatatgttcagaaatgtgtaccacttaatgtaaaaactgaatttctgcaaaaaccagaaatttcattcacctaattttaagaaatgacaaaaaaaaacttatcaaacttgtgaaaatgcatcatatagcgtggcataatcaaatggacaagattcttccaaaacactagggcatacatatcctcttttggactgacttataataatagggtcttcatattcaaattagtttttaaaactagctgtacttttcagaaaactaatgttttcctatatttcatatgaagatgcagatgcttttatacctatataaactgtaaagttattggttgaattaataaacagaaaaaatttacttaaatatgaaaaagatacctattatgtcaaagctccttgttactgaaacatagttaattgaggccttaatgagtgcttaccacaaagttatatgtatagccatatgaactaattaaagaaaggcaatgctccagagtgtagtgaaatttacttcatttaggttatggtactactttttggttcaaagactatactttttaaaaagtggatacctgcggtccatctctggcttcatagaagtcacccactcttatttttgcactgaagctgaaattgtcccttgagatatccattattccatttctgctgagatactgaaaaaatcacatatttttccacttcaggttttaataattacaacccagctttgatgtatagctagcttcaggacactaatgttttgcatattctatcaaggggctctaaatttataggagatcaatttaggttaagtacaatagtcccatacaagagaatatttagtatcaaggaactttatctgagaaaggagtacactttttttttgtacatgatcatgcttaataggcaccaaatgtacattatttggtgaaaagtatgtacctttattacttcagggtactgcctaagtttctttccacatggagcataatatgctacttctccttgaaggcgccctccaaagtttcttattcttgtctctctctgccagctacacataacagaaatgaaggttatgacatacttaatttcaagaaagcttttaaaaattaaaaataagttaaagtatacatgttctctagaaaacataaaaaatgaaaacaaaaataaactcctcaaacaacccaaatacattaactctcaaaattatttagatttttagctaattcaactagaaaattaattattcaatttatatattaaactccatcaaaatttttagaaatcatacttgattactttgggtactctgacatttcagtaacatgttaatgtgtactgattttttacatctgaaaagctttaagggaggagtaaagtaaacctggctctctgctgcttggggttcacgtacatccagtctaaaagctgtcatttctaattaaaccattttagccaaactctggttgagtccctcaattttgaccaaagtggcttttactgtcctttaattctatcttcacaaaaacttctcacagtctcatgtactcctgccctttgccatctgatttgctcttggttctttttcagtcatgttcctacttggctgtatcatcccaccccagctctgccatacctccaggaaacaggattaatttcagttttctgatataccaaattccttgccctttgctccggctcttctgctctaataaatactatgcagctatgtacttcttctattaattgtagagaatgagaaatcaagtatacatcaaacttgcataaatatatgggggaaaaagaaaaaggaaaaccttattttgcatacccatattccaatggaatacgcagttcacgttcatctgttactcttcttcttttggaagtgcctttaaaaaaattcaattggttaatataaaacattcattaatataaataataatattgatagtttagaaacttttctttaaaaaagtatatgttaataacttggatttagtgtatttctgtaatttatacattatttttagatggttttcaataaaacactgtataaggcagggggcttttttcttcttttgggtctgaatgacaggataactagtttttctctctaaagaaaatacaatccaaggtaaaaatatacacctttcctctcattttattattaaagaaatggctagagaagcaggagagaaatagaggtttcagaaaatctatttaaactgttgactttgaaaataggagtttttggatgctgaaaaatttcaacagctggctcatatatttaaagacgatttaatttctatgtccatataaatccatagtcaaaaacactaccaggtcttttaattaacctaagccaccaaggaacaggattatgattttatgtaaaaattttctaagaccgagatcaagtttcacaaacacaaataagttcatctaaaattagtaggctatcatattggtatgtggtaaatgaaagtaaagctagaaactgacaagaggagagtgaaataagtaaaacaacaaaatattttactatatacatctatattttcttagacattgaatgagaactgagagtagttgtggaatattaagtgtataaatgtttaatgaagacctctaggaatttataaaaagtcaaatgggaaaaaaaaggacatggcacgttaatggaataagaatgctactctctaatagaaaagacactggctatatattgggcagatagcatcttaagtaaccaagtgagcttttttataaagtacagttggcccttgaacaatatgggtttgaactgtgtgagtccacttatattcagattttcctccgcctctgccacccatgaaacagcaagaccaatccttctcctcctcagcctgttcaacatgaagatgagaatgaagatctttataatgatccacttccaggtaatgaagagtcaatatatttcctcttgcttatgattttcttactaacatttttcttttctctttattgtaagaatacagtatataacacatacaacatacgttaattgactattcatgttatcagtaaggcttctggtcaatagtaggctaacagttaagtttttgaggagccaaaagttagatgtagattttcgattgtgtgtggggccagtgcccctaaatcctgcgttgttcaagggtcaactgtacaaaaaagtccaactgtcaattaaattctatattctagaagcacaaactgaacacaaaagcagaaaggttcaaaaccaaaggaactatcatcaatcagatccttaaactggaaactcggggggaaaaaaaagaccaggtaatgagtcatatcctttgaaaatacaggctcaccttccttagccaacctaaaatctaactttaatcttgattccagtgagatcatctccagaacactcttatcaataaaaattcttgctatggtttgacttctactttagaataataaaaataaagtgtaggtaccagagtgtgggcttgaagtaagtgtggaagaagatgtaccaagaaaagcaggtgactgggattcagaacataaggcagcaggagcagagcctggggcttttgctatgtggaggttacgaggtgttgagtgacctgtgagactcatggaagggcttttgacagaggaagttgttttattcagtttcattgaagttttctctccttcagtatcactatctgattcatcttggtctttatcatcatcatcttcttcttctgatccttctgtatctgattctgaattactatctgattctgggaagtaaaagaagcatttgtatattataactagataatcaccaataatttgcagtttgtatctaaatggactagctcaggaaccagcacctgtgaatgagaactcaaatgagcaattttcctacagagtaaatgttataagctatttgagaacagtgtatttaggctatcaatcttcaaaaacaattttttaagtgtaagttttactcaacactttaaacagttctcatgtgacactattcacatgatgagttctgcttaatggcatcaaaataattttttatttaacagagaaactaaagtaaaagaggggattaaattgactgttcaaatgaacagattccaatggcttatgaagtacagtaagtcaaatatgagaaagagaaatctgaaactaccagcatacttccatttgggctttggagtaaaagaagacaattttcaacaggagattcttggtcttttggctgcagtttttctatttacatacaagacttcatcaggcttttcaggcctctcaaaaaaccaggcttacagaaataattatagtaggataattcaataatttaagtttgttctagctacgtagttctatgtatgatgcatccattcctctacatatgtaaaatctattactagattaaacttgataaacacaggagtgatacttagactgtttcctcatagttcacggtacaatagcttctgtggaattctggtttgtgttataccatttgcctatattgaaattcattataaaagttagttttgaaagttatgaatattgatatttatgatctatcatacaaagttgttttatggaaaccccaggaagagtggttttaccctgagcacgaagtttgtttttaacttacagacactttaaattgtacagctgagtatattttcctattcatattagctgctaaaaaaaattagttgaatctgtagttgaccagtaacaaatccacaaacatttataatatgtatttcatttttgtattcgcaatttaagctctcttgtattttatgttttcagtcttctgtggaatgaggagagggaaggaaaataaaaatgcaaagaagttaaccctagacccagcaaaaagaaaaaaaaaagtgactcaaaattaaatcagagagtcctctatatgttatttaacaaattttctgttattgatgaacattcatagagatttaggtttttggtactttctgaatgacgactataattttatctgtgttcaaaacagctggtgatgcattttaacaagtagcagaagaaatgaaaaaagagtggtcctgaatgaaataaaaattaagcaagttgatgaaattatgtcttaatttatgcatcatttgtattcaccctaaagtgattatttgtttaatgtcaaatgaataacaagctgagaatctgacttaggatttccagtatcaattactcctgtattttatgagctcattatagaaatgcacaaagttgtgtgaaacatagtaaatgacgctgattttaagtctgaattaagaaaccctttaaaatgtttggttcacatagcatttagagaaatactttaaattttaaaatgaaaataacctgattggctgtcatcagattcatcatcttcatcatcttcctcatcttcttcttcatcatcttcctcttcatcctcatttgaatcttcagaatctttactactgggaatgtctgaatctgttcctctgaattgttccactaaagattttgcaggatgggagtgatgctgtgtttttactgggtttacattattgctaactgctttttccttcccttgactatgcaggatgggagaggcagagggcattacaggtgtctgattgccaggggttcttctcccacttgtactcagatttacaggtgaggaaaaaggggtgctacttgcagcagcaatgttttcattaatcttgctctgcattttagttttggtagtaagtgctagaggagcttcttgaatgacactttgaataactccatttggttggtgattacctaaaagtgcatttgtcaagaatggatttgggtggttgttttctaatgtttgttttggatgtgctggtgaactagaggttgcttttggatttgacaaagctgcaataaccttcttcaggctcttcgatgactcttgtttctttaactgtgatgggaatgcctgtttatattgttcctgttgaaacataagttaaaaaacacaacaaaatgtaccacaaaacaaagattgcttttatttgctttcaatatctgaaaacaaattatagctattatatcatatataaatttaaatcatgatatacaaatgctgtaaaagtagcaacagctatgactagttggttgctacattttggctctaatttattaaaatttatttagtttttccccattaaaaattatatgccttttgactagcctcccctctttactgttgcttccattttcacaataatccaaacttaaaaccattttctttgcatgaaatagcctcctcttagaaatttcaagctgacaaaatactgtttattcttcaagatccaaaccaagaagctttccaaatttcccagccagaagcattctttgcctctttcctttgagctcttttacctctttatatagatgctcctcagcttgccatggggtgacttccccataaactcatcgaaagttgaaaatatcattaagtcaaaaatagatacaatacacctaacctaccaaacatcatagcttagtctaaactaccttaaatgtactgaaaacacttacattagcctaaagttgagcaaaataacctatcaacacagtaaactgtagagtatcagttgtctgcccttgttatcatgcggctgaccaggagctgtggctcactgctgctgctcagcatcaagggattattgtaccaatttctactgaatgtgtatagcattcgctccattgtgaagttgaaagatcataagtcaaagaattattattattattattattattttttgagatggagtcttgctctgtcaccaggctggagtgcagtggcgcgatctcggctcactgcaacctctgcctcctgggttcaagtgattctcctgcctcagcctcccaagtagctgggactacaggcatgcaccaccatgcctaggtaatttttgtatttttagtggagatggggttgcaccatgttggccaggatagtctcgatctcttgacctcgtgatccacctgccttggcctcccaaagtgctgggattacaggcgtgagccactgcgcccggccaagtcaaacaattctaagttggtgactatatgtactcttatgccataccacctttagtatacatagaatatgcctatatgacttatacctctaaggagataacttaacatctttgataaattcctcagggtagaaacactcatttattcacctttatggtcttcctaagacattgctcagaaccctgtgcttgatatgtactcaaaaaacaattttaggttgctgaatgaataacttcctgagcaagaacttctttgaagcaaagatttaagatactaagctggtggaaatggacattcaacattctgtgggatctactttagtgtgcctttgcacagtaatattcccgagtaaacaatttagaaaaatacaattttcttggaaaagattataaactattaagccataaaatttatgtctataaacaaaaacttatttaactattagaatccccttgaaaacaacacaatcatgaattttattaagctactataattaaaatattacataaaaattaacagcagcagaattattaaaatcctttgagttaacagaaggagctgaatttcttaatctaaggtaaaattctgcattgaaaatgattgccttgaaattaaaatcagtagtgttgtcagcatcagacctgggctcctaacactaaaatcagcaaagatttgtgatggagatttcacaagtgtaaatgctgatggaatgttatataaaatacttataaatattttattattattatttttttggactctgtcacccaggctggagtgcagtggcacgatcttggctcgcagcaacccccacctcccgggttcaagcctgcctcagattcctgagtagctgagactatgggcacgtgccaccatacctggctaatgtttttgttttttttagttttttttttgagacagagtctcactctgttgccaggctggagtgcagtggcgcgatcttggctcactgcaacctccacctcctgggctcaaacgattctcctgcctcagcctcctgagtagctgcaactacaggcacaccccaccacgcccagctaatatttatatttttagtaaagatggggtttcactatgttggccaggatggtctcgatctcttgaccttgtgattcgcctgccttggcctcccaaagtgctgggattacaggcgtgagccaccacgcccagcctttttttgtatttttagtagagaaggggtttcaccatgttggccaggctggcctcgaactcctgacctcaggtgatccacctgcccttggcctcccaaagtactgggattataggcgagagccaccgcactcagcctgaaatacttattaaatattttaaagcagcagtactaacaagcagtaagcaatgtaaactttttatcttatttaacatctatactgtattagtttagaaaattgttaagataattctttgtaaataaaaactgtcacaaaatatttgtacctaaggcaataccttacaaagagaaagtgcttaattagtaattattcagtaaattctagaaaattatgctagttagatgtaccatttcaatgtaattttatagcaaaattcttacataaaatactttaatatacaagattcaaattttcagcagaaaaattagtgtgttttcgtttgttagaacataattatgtcatgtaataattttgtaatctttttttataggtagtaagttttccttctaaatatataggtctaaagggccatgaaaacaaaagtccctttagtattgtattttaattttctgcaactgttcctcactgtaattctgaagaatcacttcccatatattgacaccaataagtttttaaaaatagccaaagatttctatattttatcccaattactcttttatagtacacatattatcatttttaaaatcaggagtgatgtgtaaaaaggagatggagagaaaattgagacctgtatagcagcaaatctcttgctgctttaagatatccatttggggccaggtgtggtggctcacgcctgtaatcccagcactttgggaggccgaggcaggcagatcacttgaggtcaggagtttgtgactagcctggccaacatggtgaaaccacatctctactaaaaatacaaaaaaattagctgggcatggtggcgggcgcctgtagtcccagctactcgggaggctgaggcgggagaatggcgtgaacccaggaggtggagcttgcagtgagcggagatcttgccactgcactccagcctgggcaacagagcgagactctgtctcaaaaaaaagaaaaagaaaaaacagttgataaaagaaagctgacagaagatctacaaaattctactcctggtctatgtattcaatcaatctatatggatttaagtgacattttcttcagtgtaagggtactgaaggattcaatgattaaataacctttaagaaaataatgaactaatgagggatgcaggtaggtacctctacctcaataataggtactgacaaagagaaggtagtaccttttagagttgagtctaatgtaaatgtctaattttatcatctgtaaatgaggataatattagtagcactcatagatattattaccaataagttaacgtatgttcagcaattaaaacaatggctggcaaacagtagatgccctacaagtgatatctaattaagtcgcctaaagataatatttgtaatattgtgttcaaacataatggtttcctactctaggctgattctagaataaaaagcaataatcatttaattattagaattttttgctggacatatgaatttagtctatgtagtaaaatcaacagcaagaaaaacaaagatgagaaaattctctggagtgtttccagtgtttgtgtaagtagaagttatatttcatataatccattaagaatgacaaaggaaaattttttttttttttttcggtagagacagggtctcactatgttgcagaggttggtctcaaactcctgggctcaaacagtcctcctgccttggctcccaaagtgctaggattacaggtgtgaaccaccatgtctggccagaaaagtgattctttatgaagggtttttacacttaaaatgtgtacattctaggactacagaggtaaattacttgagttcacttctttgaaaaagaatatatttggccggatgtagtggctcatgcctgtaatcccagcattttgggaggccgaggcgggcagatcacttgaggtcaggaatttgagaccagtctggccaacatggtgaaaccccatctttactaaatatacaaaaattagcctggtgtcgtgacgcatgccagtagtcccacctactaggaagtctgagacagcaggatcacttggatccgggaggtggaggttgcagtgagctgagattgagccaccgcactccagcctcggcaacagattgagaccctgcctcaaaaaaaaaaaataaaaaaaaattggtattaggaaaaaaaggacattaattttaaacccaagtaattgtgaagcttgtcttactcaaacatatttatccccttatttctaaatccttagatcttgggtgtggggacttaccttaggcatgggttgcaggggagctggaatgacatgattgcattgccaaaaatacattaaacagatacatatatgaatataaaatcagagaaatttagttttctgctgtacatattctattcctggagactaagaaagtataaaaatgaaggtagaatttaacttaaacttgtgtattgtaagacaatatagaagctctatctttctctaatagtaaaattcttgtataaataatttgtaactcacccgtttggatctcaattcactggtcaataaactagattcttcagaggtatttttattccctgctttaagaacatcaggagaaggaactatgagtttcatgtaagtttcctttttggcttgatttaccaaagataaaggtttcacattggacaccaatcccgtagactgtattacactggtgtgtttgttcacagattcctcctttgcctgagagctttggaaaataaatggaagctgctgtgacaaaacctgaggctgcttctgctgggattggaatgagtgagtctgggattcagacgcaagaggtaatggctggtgtattcttttttcctgggctttttcagttgctttctgtccatctgcttttgggtctgaaataccatgtaatagcacctagatataaaaatgaaaaggtaagttcctaacatctattaagacaaagactatcaagcagtaaaacctggagataaaaacgggtactttcaaagtgttcttaatgccttatgataatatctaaaaatctaaaaattcgtaaaagaaataccgtatgtccctttaaaaacatttcttcatcttctttcttgggcaaaagtatgaactcaaagtaatgattaactttaaaactacagactttgagagtcaagataaaccagttaattcctaaatatgaataatgtttggatactgtccatgaaaaaaattatacctggttgttacttttatgttgtgcttcactctctgaatcagaatcatcatcttcactttcttcaatactttgatcttcttcttcttcatcttcttctagatcatctgaatcactgctactaatgccttcacttgaggtgtctgatgatgtgcctgaatcactatcactgttgctagaactttccattgctttcttccttggtttctggataacgacaaggtagttggcaagactttatttttggaaaacattcaagtttcaataaaaggtgtactctttttaattttcaaatgatattttcaatctcaaaatgtcattgtaggaaaaagtcacatatcgtaaggataattatttaacaaactgatcaacttaacttacatgacagaactcctcaatgaaaagtgcaagctctgtcatgtagaatattgaaaatatcaatatagcatatgtgtagatgtactcatatgactgttattcttcaaaatgtatgacagattaaaaagatcagttcacaaaataattccaactatgatacatacatcaaaagttacacatttagctttagtcttctttctttttgcagacagtgagtcagtagccaaacatttacctataacatgccacacacacctttctgggtatgtccaagactgagtccttgccttcaagaaacttactagtgctggtgataggggagggtacacaaatgcttaatataaaagcaaattattccatataataataagtgctgtagagaagataaagtagggtagcaaaagacctatggggctgctttagttagggtcaaggaatttaactgtttatgtttcatttcagaaaatattaaaaaaaaggtagaagatgaggtagataaatatgacgagagagatttatttttggaacatttaagactctgcaagaaaaataaaatccaaagctggtagaaagtggttattaggtcacataaaagtgaagttttgtgttcaagaaaacataatagtagtggacaaaaagaggaaaaatcatgagatgtattataacaaattaacaaaccaatcaattaacttataaaagaactcctcaataaaaagtacaagctctgtcatgtagattattgaaaatattcataattatttaacaatgggaaagttaaaatttcaccaatagaaagactgaaaaggagaaacattgaaatgatggagccacaagattaagtacaatctaggaacattttaatggcatttgctgataaagaacaaaatatagaaaaaataacaataaattacaaaagttatgatcttaacagaaatacatccttttatgactactcgggattggggaatgaaatacagtaatatatctccacaacagagagccaaattgaagccacggttacagattgcaaatctgtagtctttttattgtgtcttctgaacattgattcaggtaacattcatatgagtgaggagagtcactcccgccattatattccgtttgcaatgactcttgtttttttttttttttttcggggacagtctcgctctgtcgcccaggctggagtacagtggcacgacctcagctcactgcaacctctgcctcccaggttcaagcaattctctgcctcagtttcctgagtagctgggattacaggcgcctgccaccacgctaatttttgtatttttagtagagacggggtttccccatcttggccaggctggtcttgaactcctaacctcatgatgcacccgcctcggcctcccaaagtgccgggattacaggtgtgagccaccacatctggccttgcaatgactctgctttaactgctccaaactagttacaagaaggcctctttcaaagatacacacttcaataagcagactaatagttcccatcatttcttgagttttcttccctcaaagtagggcagacaggaacgagaaactgaattggaattgtatgggtacccacacaatgagaaagatcacaaggtagagagattaaaggaaaataataatatattaatattaagactaccatttatttgtcaaagaaacagctacttctttgcaaccaaaatctgttgtagttttctaagcatgtatagcaagaccacgaaaatcataaggtacctaaactgaaattaacatttttgttttagtaagggataacaaagaaaagaaataagagagctacagtgatttagcagagaaaaattaactcctatttaaatgcccaaggaataagtgtgtagctttttatttaaagatggcatgagaaatggggactatactccccaggaacagtcatccagaggtactggttctgaagctttagggtgcataacattcctgagtcccacttctagacagggcacttaatgtgattctgatgcagggagtctctgccgagcatactttggccatgtgtaaatagttctatttttataaggtaacacatttagtactcattaaaacaaacagaaatgagaagacaagtgtgagtattagagaaatagggaaaaaagatgggtttgtatcaccagtttcattagagtatatatgtgtcatttccacaaataattagctagtaagtctcttttctcttatttaaaatgttttattacttacaaattttttaaatttaaaacatttttttaaatgagtcagggtctcactttgtcacctacgctggagtgcaatggtgctttcatagctcactgcagccttgaactcctgggctcaagcgattctcctgcctcagccttcaactagttgggactataagctaaaacattttaaaagttagtcttcttaggtttatcaaaaagtgatcaaagaacagcttattaattttcccccatccaatctgggaaaacttttcagaaccttatccttgaaccttcatttcactgtatatttatttcttttagtaacaaaacaaatacatattcaaggctatgatgtaccaggcatagttgctcaagtctctggggatacaagggtgtgagaaacagacaccagctctgcctagtgagaactagaagaagagaatcaacaaacaatttaaataaatattttgagtgataaataccataagtaaaacagaataactggatagacaatgtgtggtggggagtggggtggggttttgctttacatgtagtcagcaggtaagacatttctgagctgagacctaagggagagcaagagccaatcacccaaggacataagagaagagcctttcaagacgggaaacagcaaaggaaaaagccaccagctagaagtgggttgagtgtgttccaaaatgaaaaggtcagcagaccagttagagcatagtgaaccagggagacagtgataggaaataagcatggatgaactggtggaggtcagatcacacagctcttataagtcatggcaaggactttattcccactgggatagaacactagtggagggagtgatgacatttgatgtatacttccccctcatttttttattgtggtaaaatacacataacataaaatttactatcttaaccattttaaagtgtatggttcagtgatattaaatacattcataatgttgtgcaaacatcagtgctatccatcctataaaactgaaattctatacctattaaacactaacttcccatccctccttccatgctagccactggcaacaatcattctacttcggtctataattctgatgagtctaagtacctcaaataagtggaatcatacagtacagtatttgtccttttgcatctggtttacttcactttgtataataatgtcctcaaggttcatccatgctgtagcaaatatcagaatttccttcctttttaaagctggataatactaacatgtatttatgtatgtgtacacatgtgcctccccatgtattttgcttatccagttatctgttgatagacactttggttgtgtctacatttcagccattgtgaacaatgctgctatgagtatgggtatacagatacctctttgagacactgctttcaattttgggtggtatatacccagaagtagaattgcagaatcaaatggtaattcaatttttaattttttgaggaactgccatactgttttccacagtggcagtatcatttactattccctaacatgtgatactttcaaaccataaaaaatcagatatgtttttaaaggctattttggttgttgtggtaagaataacttgtacgacagttgggataaaactcattcaaccttgaattgttttattcttttcttaacaggctgtatattttagtcttagtttaattatttaattaaaatatcaatatttattctaaatgtatatgcagactatatgaggggactggacttaatcaatgactttcaatgagaatggctgagataagtaccccacctcccatgggaggtatcaaaattagctgaacttttttttcaaactacatgtgaaaagaatgaatgaagcaactttttaaaaaagttttgaaaactgaagaaatactgggtgaaaaagtataggattttcttctttagttccaatgccctttatctccattttacttgagcaacccactcccacaaacccatgctgaaccacatatcatctgaaagtgctgttcttttgaaatcataagttctagtatgcctcacttgaatagacaatctctctataatgttatttctgcttagttgccttagacactactatggtacctcagaatctatctctaaaactgggtagaaagaggtgcctctttgagttttcagtatgttctcctagtaacagtttttagtatgacagcactgattctgtttaggaatgtcaatgtagattcctcattagaactaagtacaggaactgtgtcatattcatgcctccaagatcttgtacaatgccttacacattgtagaggcaacaaagattttacttgattttagcactacttcttaagaggtaggatagcataagggttaaaagcatgggcatttaacttttggaagcacatataaaaatgcatccaatgatatgatgtctgggatttggttcaaaataatatgggaatcagaaatggatggtttcagtcagtgtctggcatcagagaaactggcagtagctcagagataggaccttagcgcttacaccgagactgccattgaaacaaatcctatgggagaagagccaagagcaggtacagaacaacaggtggagagtatgacactgatacctgtgtccctgggaggaaacaattaagaatcttttatcatgtttgcttcagtgctcagtggtgtaggttgaaagggaaagaaaatggttgtcttggggcctatgtacagtacttttgcatttttgtgatgggtaccgtcaagcttcttagcattaccagatggccttcccccaagtcttcatataagcatgttatactctggaaaatgttttctattgagaaggaaatttaaagatttagaggaaatatatctatgaaatatgctcagcaaaagaaaataaatgtatttgttcagttctgtttcatttgttccagaaaatatatggagcttgatgctgtcttgaaaaaggataaagaaagtttgacaaagtagttcttaggattaaaaattggtgtataagaggcagtagttcagatttaaagtttggatcaatgtcatgtgcagtcagtgactacccatatcttgctattcttgttgtgatgtatcagaagcttcctgtcacaatattacagctgagatggtgaagaacatcatgtgtgtaggatcacaaacttttgactctcttccactggaaaaccaggccctgaaagcagtttttataaaacacagaagagaagacacaactcttatctttgtttcccaaatgtttgcagttgatgacaaggctttaactgggacctctcactcaagaagaaattaaaaattggagcagactaaatccactgataagagtgttctaatacataatatgctagatcatatagttagaggcttctcagcttacttagttagataaatgaaacctggactcaatgatgacctacattttataaaattgagatgtcacagcttctgacataatgtggaagagggaatccaaaagtgcagagtgatcagaatgtagaagtgaatttaccacctgcaagctgcatacccaccctactcctggaaccaatgataagagccaacaagatctactcaggaggaagaaatcgcattaacaatctgaacaggaaaaatttaacataaagaattattgattaataacagaagattaactactaagaggaataaagtgacctctaaataatacaggaaaaggagatgtagggaatatgtactttttgtagggctaaggtagagtaatgaaataaagataacctttgaaaagggactttttcccccaaccccttcattcacccaaggctaagtttcagactttgtgggagaggatgtggctattgcccactggatggcagagaaactcaatgaggtatcacagtcaaggctgacacacacaaaacactgcttgctaagataccagaaaaacatggctgggaacctgtcagctacagtggcagtaaaattagtttgaaagccacctacttttcaaaacttgctagtaaactgcctgctgagatgccaatgaaactcactagacagtgtatactactgggtctcctgaccaccactggatctcctggataccaccagtagagaagctgtcagccagcaagcaagccacccattggcagccacagcgtaagaaaaagaagaaaacactagaaccagaaaaagaagtcccagccacatgtggtggttcatgcctgcaatcccagcactttgggaggctgaggcggtggatcccttgagctcaggtgttcaagaccagccttggcaacatagtgagatcccatctctgcaaaaaatgtaaaaattacctcggtgtggtagcatgcacctgtagtcccagcttctagggaagctaaggtgggaggataacttaagcccgggaggtggaagttgcagtgagctgagattctgccactacactccagccagtgcaacagagccagactctgtcaaaggagaagaagaaagaaaaaagaagaaagaagaagaaaaagaagtaacatcttcttccagtgttcttccaggaccttctactaacaaggactaacactgcaagaagtggcaaagaagaaaagagtgattgagagctgagaggcaataaattgataacttgcaaagttggggatatacatgaaataaaactggccatgatgcgacaactgttgaagctgaataataggtacaaatggtcattctgtctactttgtatatttgaaagtttccataataaaaggttttcttattcactcttttctaatgcacaggagttaacccacttgctttcaaatcctggctcagtcacttagtggctaattattttggtgctttgcttctccatttgtaataacagtagctacttcatttcggatacagggaagagttaaaagttatatgaaaagcaattagagcagagctgatatgcagtgaattctcaatacattttatctattattactatttgtattatttatactggtactgacaccataaatcacgtatctataaaaataaaagttggtaattcataagaaattaaaccatagattctgttgatttgaccttcagaatgctcatcttatatatagatctgttatatattagtccttccaagtacaacttaccttatctttgattttgtcaactctagcatccaaaggctggtttttgctttgttcctgattacattttcgatttcctccacctgagcttgtacttttagtttgtcccatggaacttgaagcagtagtggatagtacagatgtgttgataccaattacagatgatgtattacttccatttattgacccatttacaccttgaaaataaaaataaacatgtttatacaatggaatattattgcatcatttaaaaatgaagtacagatatatgtacagttggatgaacttgaaaatatgataagtgaaagaagacagaaaaggtcatgttgtatgattccatctacatgaaatattcagagcaggtaaacctacagggacaaagtgaaaactgatcgcttccagggctgagagagaggggaatgggaggcaactgcttaatgggtacaaagtttccttttgcagtgataaaaatgtttcagaacaagatagaggtggtggttgtacaacactgcaaatgcattaaataccagtaaattattcactttaagatggttaatattatgttaagtgaatttcacctcaattaaacaaaatgtttagaaagataatgaaatgcaaaactttgtgttttaattgtaaaacacattagagaactttgtaaaacacttcagtgaaaagaaagatagtaaatcatctaaaatgttgttataattttcaaattatattctaacaagttattaattgcagaaatattagtgatcatttaaaaaagtactaggttattaattttaatgaagttaatacttaattacaaaagaagtaacacactatattgggttacatatagggaggtaatgaaatacagaggaaaaaacagtagaattgggctaaaatcctgactaggccacatccatatgtaagtagtattttcttgaacaacttatttgaccttggctgtaaaattaaaatacttctaatctcaaagaattattttaagaattaagcaagaaaatgtgaaaaggtctagcataacactataaaactgttattaaggccgggtgtggtggcctacgcttgtgatcccagcgcttttggaggctgaggtgtgagtattgcttgaggccagaaggtggccagaagtttgagactgctggaaacacagagaccctgttgctacaaaaaataaaaataaaatttaaacacgtagctgggcatagtggtacatgactgtagtccttgggaggctgaggcaggaggattgcttgagcccaggaggacgaggctacagtaagctatgatcatacaactgtactccagcctgggcaaaagagtgagaccttgtctctattaaaacaaacaaacaaacaaaaacaaaaaacaaaaaaaggtattaaacctgaacattatgaaaataatattagaatggaagatttatagtacttcacttatgtaaatgtggatacctttttcgggaccatttcgattactttttcccgaagtccttgaatggaatgaagaagaatcatgattctgggctgggggagcaaatagtggtggaattcccagtaatggtggaaagaaggttgctcctgtacgagtatgagcatcagttgttcgccaccattctgcacctcaaaaccaaacaaaccaaccaaacaaaaatatataaattaactttccagttaacgtcacaatggctttctatgttttatttaaaaaaatttcaagtttcatcttggaacaaaactgaattactcatacttctgatcattttcctaattctaaacagtagaacttgtacacttatcactcttctcattaggtcagtatctaaggatcttcacttggcagctttgtagagttcaaacttgtaaaggacaaaggtagtccatagtttaaaaaatgaaagtgaaaacttggaatataaaagaagtatttcactctttgatgacttatcccataacttttctcatctgtttcaaacccttagaatttaagtttacatctacaacctatgttaagactttcctcaaattacatacaatataaatctggctctgataaatcagttagtctaaataataatataagactattgtaatccactatatctcaagtacatttatggaagaaaacttctatacttaaagataaccataaatatagcaaaatcagtaggcctttttatgttctaaaaaataagttctcaaaggagatttcaaaaacaagtaatttcacattaaaatattaaagatttataaagcctctccccttaaagttaatgatgaaagcctgaattttgtttttacttccactcattaattacagataacaatgattgttttattgatataaaatgaccagtggtagaaaatcattcaataaaaggtaaatacttaaatagtgtctcttaaagttttagaaaaggaaataagccaaattttatacatttttcaaggaaggatgaagtaatcttatattgacccatctaaaatctcaaaaacaatcttctccaactggctagtctgctagattaccaaatcagttattatctttcagaccaatctcccaaaagatatggggtatttttcattgactgtgacaaccataagaacattagaggaaaaaaacccacaacaatacagtatgggagaaactcaaaattgtcagtctttatattatataatattaaaaacttttctaggaatatccttcattaaaaatagaatgtaaaatggtatgcaccttcattatctaatggcaaaatctggtttaaaagaaaagtgaaattttcatggtagctgccagtctcaaaggtctaaaaaacagtataagtagaaaactgcaaaagctattcttctgcactgcaggaaggcattactagtaaaatgacaccaatgtatattcagccatgcctgaacaatgggaactgaaccaagaataactatacaaaagcattgatcatttatccaccgtttagatgaaagatgtacatttagataggaagaaaaagtatgtgttttgggcttgtatcagcacagtcacaatcttgttatttataagtttgaaagctaagttctacctagctgataaaaagttactgtactgaggaccaggcacagtggttcacacttgtaatcccagagctttgggaggctgaggtgaaaggttcatttgaggccaggaatttgagatcagccttgggcaacagagagagaccctgttgctataaaaaattttaaaaagcagggagggactgaggtttcccaaagatatttatataatttaacacagagtctgtaattaaagtggaattcatagactttgtaaacaaccaaaaaattgctaaggtaatcaaagtgtaataagactcaaatattttagacataatcaaactcagaaaaaaaattttaaaaagtattggagaatgtcaatggtaaataagcacatagctggtgtggtggtatagttctgtaatcctcactactcgggaggctgaggcacaagaatcacttgagcctgggaaatggaggttgcagtgagctgagatcgcaccactgcattccacagcctgggtgacggagtgaaactctctcaaagaaaaaaaaaaaaaaagtaaagaagcacacagtagagattagagaaaacaatgggaaaatgtgtgttataaataacctgacaccacagaagaaaatacaaaacaataagatcagttaaataaaaagatgtgaatggtagagcttctgactataaactttacaaatgtctgatactatttcataggaaataatttttgttaagtgacaagcttgtcttctaaatttaggaaaataaacaaaatttagtcacaaaccagcttgttgacaaaatgaaaaatacaaaataaggattatataaatcagcatatggtaaatttctaagtatattcaaaagaaagaacagcatagtagcaacatttaactcttttttttttttttttgagacagaattgtgctctgtcgcccaggctggagtgcagtggcctgctaggggctcactgcaacctccatctcccggattcaagtgattctcttgcctcagcctccagggtagctgggattacaggcatgcacaaccatgcctggctaatttttgtagttttggtagagatgaggtttggctatgttggtgaggcctcaagtgatctgcctgcctcggcctcccaaaatgctaggattataggcacgaggcaccatggccagccaatatttgacatatttaactcaaagattctattaataatatttcagaggacataacagatctcaatttgaacctagaagatttagcagaatttaaaaatcgttcatacttgatagagccaaaaatacttcgcaaaaattcatggtaatttaatatgaaaattaactacaaaaaagtacaaatattttttaaattatcatgaaatactatttcaatataaaatggaaataattttattatgctaatacccattaaataaatttacatttattgatttaatctgaaatgcataatactttagaaagtgcataaaatataaaaaattattcctcattaaaaactcctagtaatatcttcctgttgtgtcctcatttatttactgggcaatttaaaagtctggcaatttggttacccttctgaataaagccaattatagaaaatttatatttaagttactgtaggaaatctgcaaattaaacaaaatgaatctttgaaaactaggcatagtctctgcccatttggcaaaaagtatgctcatctaggcatacttttatcactaaagactctgtcttgtaattgtctgttcatctatctcctaaaaactgtaagcaacatataatatactatgtttattcttctgtttctggccttgtgtgcagagcatagtagatgtccaaagaattttgtaccttaaatgaataagtgaatactttattttggctgggggagctatcaaatttttttctatatagtagaagtatcaacattattgaactccagatgagtaattttttaaatgtgttaaccatcattctagtacaaaagacatttgattttaataatatagtatttacattgtggcttagaaatgttcaaaagcaacagtgtaataaagcatgataaaacaataaaaatatttaagatatcactatctatattgtttttatctattttgatatttattcagcaatcttgtatttcagtaaatatctgtggaatgctcatcttgctaaacaaccatgctagaaactgaataaattcctattaatatttttgaaggaaatgttaaaacttggtttaagacttctttaactgtccactcacattactcctccttagcatccctgcttcccagacaactgaattaaagaagtaatatgactcaagaaacagtacttgaaacacacatttaaccatctatcctttctacacgtagttttaaaaacacttctttccttttaaggaaggatttgataaattattaaccattaaagtgggcaaaatgaaataataatgatagttaccaattatggactaattatgtgcaccagatactgtactcagcactacatatgacttaactcctttaatcctcacaagaaccctgtaagtcagatactattattatgattctcgtttttcagatgagaaaactgaggctaagaggtcagataatttgttcaaggtcacacagctatgaactaacaaagccagatttaaattcaggcctatttgtctctagaattatgctataacgttttaaattatcttacatacactaaaacatgcagacctcactaaaatttattaaagccaaattaatctatagaaaatacatacaaatttaggctttcaagataatataacaaattgaagcacgtttgtcgaaagttttaattaactgatgtcttactgaactactaaatcctcattatctatagaattttggataatactggtcttcttccatgtaagtggtacaactctctagttgttttgatcaaatacagaaaaataggctgggcacagtggctcacacctgtaattccagcactctgtgaggccgaggtgggcggatcacttgaggtcaggagttcaagaccagcctggccaacatggcgaaaccccgtctctactaaaaatacaaaaattagccagacatgatggtgcgtggctgtaatcccagctactcgggaggctgagacaggagaactgcttgaacctagaaggcggaggttgcagtgagctgagactgcaccactgcgctctagcctgggcaacagagcaagatttcgtttcagaaaacaaaacaaaacaaacaaaaaacagaaaaataaagaaatttaagagtctagctcattttccttacagtgaagaaaagtaagaccttgaaataggagtgtaaaaatactcataaaacctgaactttagtttcacactaaataattttttaaaaaatcaaataaggctgagaaaaattaattcaactctacatttacactatgtatacttttctgtatattatacttcaacaaaaaaacatgagaaaaacttgcctgaattactctctcctgtgacagacacctatttctctagttaaatacctggatatctaattaactgctctgccacctaacacacttagggtgtttaattttttgcacatgataaataggattaagccaattcttgcaccaaagttttaaatataccaggcattagactattccttttgttcaatagacaaattattgcttgaacattctcaagctttcctccttcccttgaacactgtttgtaacagatgtttacctggaaaagatgctagttggggatgtgcggctaaggctgtgggtgtaccaagtgtccccaaaccaccaaattctgaatgccctgagctggctgaatgtagaccaaagactgggtggctgaccattgggaaggcactcgacactgtggacaggttaaacggttgatccccagctgttctgaataaatgtcctgggagggaaaaaaacacacttaaagttgtactataaaaaacagatgagacttatctgatttcagtgtttatagttaaaatttataataatttacctattacatttttattttacccttttcctgctgcattttctactcttcaaaccctataaaatgtttctagaaacatgaagacatgctaaaaatcattaaaataaatggcataaattaacttttgaatttgagatttgagaaccaatgttttaagtagataattttcactaattaaaattgtctgacctgaggaagtgaggccaattttctgttaatatatatacattaatatattttcaatatattttactcataagaagggaaataaaaaacatcctattaatctaaggttgaaagccactgaaataagtccaggatctgtcaccaggtcaatactcaaattattatacactctaagcaaggccatcccagtttcaacatgccagagttgaagctctgttctctaacacagtcatgagttgtttaatgatggggatgcattctaagaaatgcattgttaggtgattctgtcatcatgcaaacattgtacagtgtacttacacaacctaggtggtacagtctaccacacacctaggctataggatacagcctattgctactaggctacaaacctgttcaggatgttactgaactgaatacttcaggcagttgtaacacagtggtaaatatttgtatatctagacatatctcaacctaagaaaggtacagtaaaaatatggcattataatcttagggggctactgtcatatatgtggtcaggcattgaccaaaatgtcattatgcagtgtatgactatacttcttaggtgagaagagtatcttgataccaaaaagggaatatattctagtctaataaaacaatgcacaagacaacataagtacttaataaacttacaaagatatttctaaatgtgttcacaagtggttaccaatataaaaatcatttttagctttctctgagtaagacaatgttcaattcaaatgagtctgacattttaattctatttttaaagataagtgttataactccaggttggaatgttatatgataaaaacatgacttatttttcatactttgtagtaatttggcagaaaacttttctaatacttggaaatcttccctttacttccaggaaataattaaggtaccctgtcttgctactgtgaaaagagaatactctaggttatcttaagaatttactgtgtgaacagtattgtgctctgtgttaatattagaataaagcttccttattatctcttgtttatattatatcagtcctgactgtgcactgcaatttaattagttttaacatagtatgtttgaaatttacaaatgtaagttaaaaatagtatacttattattatttagttatcaaccaaatctcttctctttgctttcttgctccctgaaaaccaagggaaagtcctaaaaaacggtcagtgtaccctctaaagtctgatataaaacctatattctttattaaaataatgctatattctttactgaaacaagaagatctgaatgacttttaaaaataagatttaaataaattgcattaagtatgttttgtatcaggctatataaggaaaaagttctgattcaggatagtgctccactacaacaaagcagtaactagatctcacagggaagatcctcaaagtatctttacaaggaaggcccacaaggatactgtgaggtaagaggacaaggaaagggcataaacttgggtgtctcttctaaatcagctaatcattgtttttgttgaattggttcttctgttttatcagagtggactgcattagcactgaagatgagtcaaaataaaacagagtatgctactgccaaaaaagctacccaaatgtcattatctttaagaccagtgataggttaccagaaatattgtggtttttttttttttttttttttttttggcaaattctcagaaacccagctagtttctcaaaaaaatgagcttgtaactataaaaaccagtttttactttcatttgttattacatataaaatctctggttctcaccagtcaattcaacttcctgactcaaatgttgttaaatgttttatttataaacatactatgatcagttcttttctttctccatcaatttgtgtggtaagcaagttgaactgaacattgcagttttggagaatttggggtcatctgtaatttatgttttacaaataacaattcctaaattatatcaattacatgtatgtagttgtgatttaatacaaagaaatttgagggaagtaacctcaaaattacaaaagctatattaaatattacaaaaatccagaataattgaaattatcaaggattagaaactgatagaaacacttctgcaataactaactgtaattacaattagttgtaataactaattggtaataattggtagtaagtaataaataattggtagtaataaataataagtaatacataattggtagtaagcagcattcttagatgcatagttacagcattaatttcattattgggaagaagcaaacaagctaaactttgtagtctcacaagcagaaaacataagcagtaaataaatgaagttatcactcttgtggcaacaatgaagaaccaatgatacatactttgacaacaaaaagttcttttttaactctaaaaggaatgacatgtggaagcaactgagtagaaaatttcagcaaaatgagctgtatacatcacagattcaaatgaaaaaaatatagatctgtacacaagaatgacatctatgcctggcaagaatgcagagatgggagttcagatcaaggctacttcaactctacttcctaattctttcttctaaaattcttggttaaaatagttaaagcatggaaagcatccttagtgacgactgagtcttacaggtccattccttgctggtgagaaaaagattcacgtctatatttagtaaagtatactaagatcacttatcataattgtagtaataccatgcactaaaaaaatacccacgtgaaagacttcctgtttcatgcgggaaaggttatactagagaagggaaataatttaagaatacatttcacaattttactatattttgcctttatagcaagaatttagaactcagtgatatttttaaaaaagtaatctttttcattaaaaagttctgtaatgctatatatataattttaatactgtttttcttccatcttttacaaaacacagatagtaattccatgtaaaaatcttacagaattattctgttatttaacagtttcagtaattcaaacatttcatgaacatacctattaaacatcaggtgctatgcttaagtaactggcctacaaggatgagtaagacaatctctgacctcaaggaactcatgttttgagcataatttaaacagtgcaagactatttttataccataatgtataaaacaagtttgttaatatttcagtattacaaattggtactgtcatatacaggactcagtaatacaacccaaacacctaaaacagtgtctagtacataacggacataaaataaatgtttttaatgaattaattcactactcatttaaagcagaagaggcctatccatgggactcattccaaaggctttcaatcagaacaaaaagctgtcttgagtctttaggcaaacttgcagttatggttcctagattcctttgccttatttcctcaacccctggtcctaatttgttaacattaacactggccctttattcctccttgattccatttaggtcacatgttggatttgatcacacagaatcctaccacctccaggatcttaaactcttaaagtttcacccttgaaccacaattttcacatttccattcccttatttctcagcaccacctccagcccctcccagggccactcctttaccctgtctgtctctttccctctcaatacatcaatacctctcctgtgttaaccttaaaggaaacgtcctatacctgctatgtctacttcctcctcacttctcagaatctttcaacatttgtgccaagccccaagcctcccttccacttggtctgtaaaaggaaagttttcataattcctagatccctctaatctttattgttttcattctcaacctcttatataagtctggcattcctgactgcctctttcatattattatttttttgacatggagtctccagccacccaggctggagtgcagtggcacaatctcagcttactgcaacctctgcctcccgggttcgaatgattctcctgcctcagcctcctgagtagctgggatttcagctgtgtgccactacgtccagctaatttttttgtattttcagtagagacagggtttcaccacgttggccaggctggtctcaaactactgacctcatgatctgcctgcctcagtctcccaaagtgctgggattacaggcgtgagccactgtgcctggtcctttcttttctattctttcttttttcttttttttttgagacggagtctcgctctattgctcaggctggagggcagtggtgcgatctcggctcactgcaacctccgcctcccgggttcacgccattctcctgcctcagcctcccaagtagctgggactacaggcacccaccaccatgcccggctaattttttgtatttttagtagagacggggtttcaccgtgttagccaggatggtcttgatctcctaacctcatgatctgcccgcctcagcctcccaaagtgctgggattacaggtgtgagccaccgcgcctggcctggtcctttcttttcaaaacccattatcatccttaagatctaggtcgtggaaccctcttgatcctcttcttaactatacatctttcaataatactatctcctttattggattttcttttgcttttttccccctaaatgtaaaagattcctaaagattttgtccagctatctctttccttctcttatgctttctccttcagtatttcacatgcttatactgtttaaactatcacctctatgcaaatgaattataagccaggattttagatctttgaggcaaaaactgcatcttatttagctcaggatttccaataatctgaaacacaataagaatttaataaattgtttctcactgctgtatttttggtcacattatttcttccacttgagaacctccaaagcctatataacatgctctttgatttctgccctttataattatattctttactaactatttcaagaacctattgctcaagaagtattcctgaatctccagacagttatatttggggcctcttttcattgttcatgatagattattggcaatttgtcctttatcagaccattactagggtataaaagttatgaaggaaacagccatttttactctttacaaaacattgcacaaagcaaactgttatcagttggcagaggcaacacttcataatacctgctataggcatcttcaaaacagtacttttcaattctttgtttcactcttcttttaaaaggctagaataaccggaaattattctttaaatgattaaaatataacatgtcactttgctccaattgcaaaagtcactcacaaggttagtaaaagctcactaggtatttagaatgatgtcactttgtggctttaatctttttatacagcagggattgctgttttgtttacacccttggctccattgccaggacaatgcctttagtcttcaactatcttaacatttcaaactactgttcactaggaaaattttgatcatagactgatgatggctcagtcaatcctataattacatttaaaacaaagcatattcagtattaataaaaaagcagaaagatactttcacaaaatgaaatacagctcaagtcaaataggctctattaaccttataagtacaaaacaaaattacctggatagtagaatgtttcacttttagaaaagaaaatgtttcttacattaatatacttaatatcaacagatgtattgctcacaaaacctgtcttgatgaaaacttttgagttctgctcagagaaaacatttgcaagctgatgaattataccataaaataatatttttagaagaccacaattttttgcagatattaacattcaaacatagtttcaatattattaatgtaaatattattttagtttctattttaagataggtaactgtatacattttacataataaaaattaatacacatctgcaatgcctatgttctcaaattacaatgagctgaatatttttcagcaaagcttttcaaattctactagccaaatcaaatcactacatataaaagtgattaaaatcagtacacaaatgctggtgtgtgtcagtaacaaggcatggtaactacaaatgcctttattaatattaaagaataattcaacaaggttttccccctatcagaatgaaattgtactgaactaatgccttgactctaaactaccagtgaacaaaatctcccatcactaaggaaaagtccagaaagcaaataaaacaaaataattgtaagaactaagtatgttaaagcactcaatctttttaaaagtcaagaaaattgcttaccatgacataacttcacgtttttctgtgtgctaaaagtgtcttttaatctttcaatgctacacaaaattgttatatcatgtcttcaaattttgtctccagttgttcaaaatggtaagcataaatttgcaacattaaaaatcaggatctaatgtacatcttgcaaagtatggctattcattaaaaatggtggtatattcaaataaagttgttatgaggactttaattaatatcagtaataacttagtgtaatagcaaaaagaacatcatcaaaattactgtaaatcaaagcaatattcaaattactggctcacatattaaaattcttaagtatattaatgtttaaatatttctgaactcaaaatgtccaaattctgtaaacttgaactttgattaagaacagaaagaagtctacagttactggtgacaaaacatttctctccaagtaattctcatttcactcttgcattctaaaaatgctttgagccagttaacctttatatataattttagaacaaaacaggtatatttctattagactatctcatacagaagatagtgtggtatggatggatagtatggatgacaaataatacaaatatattttatttgaaataaacaaaaatgcatacacagctcaatgggtacttggaaacaaactgttccttgactatattactgagcaaaaacagaactgaagcacaaacacgttttttttttacatgtatgtggagataggcaggaagacattacttgttttttttttaaactgaccttcccttaaggcctggtcatagaactgtaagcaatgtaaatgaatccaccattaccagttgttatattatatctatgtcacctgtgtattctgagattacacacatacctgccaatatacctgggacaggttattttatcacagttacacttgagttcttggcaggcaggactgaggaagagtaatctgaaataagttttacatcctatttagaagaaatcgttagtatttccttaaataacaggttacaatagaaagatactgcctggaagttatccttttcattttggttcattttcagtttttgtttatgatttacatagctgtttaattcatttgcttatagtacaatcctgccataaagtattaaagcacaagatacctgttattccttcaacatctgcatttttcaagttttatactctatatccacagtatgtcagcagttcttgactgtttaaaaaaataaatggctaaaactcttctaaaaatgcagatgtctataactacaatggtactaagatgggaaggagacaatgagagaagggatgaaagcaaacgtgttcaagtgcagggaatgtggttcaagtctttggatttaaaaacaagttccccagagaagctgacacttcctttgccctccaaaaaggacctgaaaagtcccaatccaaactttggaaaattacagttctgcgatgcaataaatgatgatcaaagcagtcagagggagaaggatgaatgtgccttccacttagctatagactgtagtacagcctctttaggtgctggtggatcagtaaaaaccactgcagtatcagaagtgcttggaaggataggggtagaaagtaatgaccatataccttgtctaaatcagtagcagcgcttcatggctaggaaacttttttaaacagtaaaatgtctctaggatagatctctctctccaacattaaatgtggcagaattaaaaaaaaaagacttacacttggatatagcaataacagaaaattacaaagcagagaacacaaaagaatcagacaatgctataggttcaacagtattccatgaggttagaaaactggttaactttgaaagctctagcaaaatatcactcttgtttataaatcacttatttatcatatgaccacatgttgaatccttgtctttccacatactgaagaatcctacattcagcctttaggcattctgcatttctttgctaatgttgtagctgagtaatcttgttccagtcaattttggtgcgggtaaccggaagctgccggcgcaagaccttgaatgtggtatctgacattgtttgacagttttcactaattgctgtctgatattcattttctgcattctctatgattttaataaactccttggcagtttgtgcgtcattcgaaacagttagcgaatcctgtacatctttatgactaaccaactgaacactgccatcttcgtaatagtgaacctgaatcttaagcactccaaccacctgggctgtaggtggtgtgatggtaaacttccactctgatctccaacgaccattccagaagtttttaggctgacactcatggctttcaatacatgcaataatagtctgttgcccatcgatagtttttagcataaacagtacagaagccgttggaataatggtctttcacataggctcttaaagcactgtcacaggattctctccaagacttcagacctccatctacttgttttggctgggggtcacttgcttttttctataagtgatcaaatgtaaaggaaattttgtttcttggatctaaaactctgctattacccaggtcccccatgctctgtaattatgacctgatcttcacatccttccatcttcacgggtgtgaactgatccatgttataatgggcaaatgcacgtgctgccctttccctgaggagactgtcattattacatagtagccgaatatcactgaatacttcattaaattctcctgcgggtgcatgagtgatgaatttagcagctatgcataccttctccttatccaacacacaatcattgaagttggccatcttgggctgttctcaacatttatattttgacacttaaaaaagacgattccttaacgtgtctattgttaatcgttctgcaatgaacatgggagtgcagacatctcttagacaaactgtttacaagtcctttgggtaaatcccacaaacaggatggctggattatatggtaattctatttttagttttttgaggaacctccatactattttctataaaggctgtactaatttacatccccattaacagtgtacaagcgttcccttttctccacatccttgccaatacttgtcttttgtctagttgagaaaagccaatctgacaggtgtgagatgatagctcattgtgattttaatttgcatctccctaatgattagtgatgttgagcattttttcatatatctgctggccacttatatgtttcttgagaaaagtctattcagattgggttttattattattattttttgagacagagtcttgccctgttgcccaggctggagtgtaatggtgcgatctccgctcactgcaacctccacctcccagtttcaaacaattctcctgcctcagcctcctgagtagttgggattacaggcgcccatcaccacacccagctaatttttgtattttttagtagagatggggtttcaccatgttggccagttcggtctcaaactcctgactttgtgatctgcccacctcagcctcccaaagtgctgggattacaagtgtgagccactgcgcccagcctatttttatttttaagtagttattttgagattattttgactcacaagagttgcaaaaatagtacacagagttcctatatactgtctacccaaccttacttctccttatgttatcatcttacatgactaaagaacaactttccaaactaagaaattaaccttgattaactaattaaaataaagaatttattcagatttaattagttttcccaccaatgtcacttctctgtcccaagatccaatccaggatctcatattacatttaggtgttgtgtctccctagttttgtacagtcgtgttatttcctcagtcttgtttgttatgactttaatacactgaagtgtactggtcagaggtattctgtaaaatgtccctctggttgagtttgtctgatgtgttctcatgattagaagaggtgatgcattattagaaaagatggtcaatgtgcccttctcagagcaatttatctagggcccataatgttgctatgtagttctggtgacattaacttcgatcacttggttaagctggtatctgccaggactcgccactgtaaaactaccattttctcttcaaaaggcatttttattagaaaacaagtcactgggagccgcggtagctttgggaagaaaagctgccatttaataacatcaaacatgccgaataagctttgttcaagaaatgatgcaccaatactcaggcaaatgactattcttaaaagataaggacagttcctcttctgtgataatttttgttggatctaatgaaaataattagagttcatagattaaaatgctaaaaatacggaatattttatatacatttctatattcaaatatagctgtacttctagtaaggaaacagaaaaaactaaaagtaatataattcttgttttactttacttaccttaacctaaatcttgttctacttatgtttcaatacataagaaagtcttagttttcccataatgaacataaattattacaatcagctttgaaagtatagactgggtgtattagtttgctagagctgccataacaaagtaccacaactgtgtgacttagaacaacagaaatttattgtctcatagttctggaggttagaagtctgaaatcaaggtgtcaacaaggccatgttccttctgaaggcactaggaaacatgagttccatgcttgtctcctagtttcttataaccttgggtatgcttcctgtgtcttcacatgtgcttcctgctgtgcatgtctctgtgtctacatttctcctttgataaaaatactggatatgtattggattaaggcccaacctaatgatctcattttaatttgattagctctgtaaggtatctatatctaagtaaggtcacattctgaagtattaaggggttaggattttaacctatgtcttttgagggggaggatacaatttaacctatagtatttgctttatttttaagagaacttaattgacttgaacatattaactttctcaagtaacctactactaaaatcccaaattaaaactacaaagttctactaaaaagtgaagtaaaataatattctgaaaatacttgtgatcaaacctttcattaaataaaccccactgcaaaaaaggctagacagttgaaaattcaacagcctgaacaggcgcgatggctcatgcctgtaatcccagtattttgggaggccgaggtgggcagatcacttgaggtcaggagcttgagaccaacctggccaacatggtgaaaccctgtctctaccaaaaatacaaaaattattcaggcatggtggcatgtacccaacttcttgggaggctgaggtgtgagaatcacttgaacccaggaggcagaggttgcagtgagctgagattgcaccactgcactccagcctggacaacagagtgagaccctgtctcaaaaaaaaaaaaaattcaagagactttatttaggatgtatagatgcctacaacattaacacatcaactaaaagagaaaatcatgctgtaatagttcagagtataacataaatactcaaagaaactttggctttatccacaaaccatcaagagcaggcctatctcattccctgatgattctctactaagtataaacttaagtcttggctgtctcttaagttctagttaaaccataattttgactttcaggtttgtttttcatacattgcctcttcagtaatctcaactgatcttttaaattccttatcctgtagcttatgatgcccatccccaactaaaatctgcatagtcacttgattattaccagagcaatgcacagcacagctcagaaaacttattaatcagagttaattatcatttaagttttaagtcttagtcctgtaaattcatctctccttcccttcctttcttcaataattgtttcttattattatatattttgtgtcaggcactgactggatacatattggtaaaacagataaagtccttgccctttaaatgcagaagaattgacaaataagtaaaacaacaccaaatgtccaattctaaattgtgaatagtgctatggaggaaattatagctgcagcaattacctagagactataattagaggtctaattaaggtctgtattagtcaagattcttcacaaaacagaaccaacaggatacactaatttattatatatgatttattataaggaatcgagattatggaggctgacccaggaaagctggtggtataattctgagaaccgaagggctgatggtgttaagtcccagccacggaagaagactgatgtcctagatcaatcagtcaggcaaagagaactactcccctcttcctccattttttttcttctctgcaggtcctcaatggattagatgatgcccacctacactggggaggacaatgtgctctactcactccactgattcaattgctaaacacccttacagacacacccagaaatagtgttttacctgagtacccacgagccagtcaaggggacacatcaaattaattattataatatctcaggatatctaacctgagacaaagcatgaggaagaatcagctttatgaagattttccagacagagggacagcgtatttgaaattctgagttgggaaaggatgttttgtatctaagaagtaaaaggtcagggaggctgaaagataaggggtcagaatgagaacagtgccagacaaatttgagaaggcaggcaggattaggtcatggaggatgtgcagccttatgtaaaaattaagttgaaagtacaaaatatccagctcgatatggctaggtgaaaaagttaatctaatgactcacaaaactcaaaagcttttggaaaaggctcattgtagagatgaagaagctagactgaaggtttaccaagacctaatttatctctcctcttctggttctgcctccctcagacgggcctttcccccccaggtttctggagcaggaagctgcgggggccagtgcaaggggaggtatttttcctcccccagcaccaataaaaatcccagaatggaatctctttgctttgattaattgacttatgttgtgtccattccttaaccaatcattcttgtctaggaaagatgatatttggattggctaggctgggtcacatgccacacatctgtagtgtcttaggaaaaaatttttttaaattaagtgatttattttggggtcggagacaactgctggtaatggtggagtgaggtggtcgtataaatcctccacagagaataattactaaaattgggctttaaaaagccccctgaaatactggaaagcatccaaaagcagaagaatggcagaggagagtttagtctggaccaatggttaacaagaagtaaaaagtatgactttgtagctttctggtctgctgcctaaatcacatagttataactacagatgatggtcaaataaaaaacagcaggcttatcaactaaaggtgcaagaggtcagaattcagagctaaggcagcatctcaaaatgtaaaggggaaatcttggtagtgagcaaaccacagcaagtatgagacccaaattcaatttaaactatccaaacgcctagctgcaagtatactgtgcatgaatgaaaaaggactccagggtcagcacaaactagctggcagagaatgaagataaatctactcttgaaaagcagagctgtatatagcagatctgctgggtttgatgtatttatttactaagtgcactccctcatcatgattatctcaggcggcaggaagtacgaagtgtcacagcactgagcccaaagcaggcagagcaactgaaaattagggggtaatcttagaagaaaaacaacaacaacaacaacaacaaaaacaaaacccaaaaaagaaacagaggaaaggagacccatctctgcctaaatactttgccaatcaagaattttcacaggtacagaggagacccagaggagtctagcatgaaaaagcagaagtgggaagccaaaagaatcatagcacaaatattatcagtacattttctaaccacagtaaaactaaaatggatatcgattttaaaaactaaatgttaatgacttccaaactacccatcagccaaagaagaattaacaaaggaaaatagaaaatgtttttactggaatggtaagaaaatgacacataaaacttatgtgccgcagctacagcagtaattacaagggaaattcatagcattaaatacatatataagaaaaggacaaaggtgctagataaacgatctaagcttccctctagaaagtaggaaaaggccttgtgcggtggctaacgcctgtaatcccaacactttgggaggccgaggcgggtggttcacaagttcaggagttcaagaccagcatggccaacacagtgaaaccccgtctctactaaaaataaaaatataaaaaaattagctaggtgtggtggtgggtgcctgtaatcacatctacttgggaggctgaggcaggagaattgcttgaacacgggaggcagaggttgcagtgagctgagattgagccattgcactcagcccaggcgttagttcaagactctgtctcaaaaaaaaaaaaaaaaaagtagggaaaaagagaaaatcatacccatagaaaaacagaaggaaataattaatgagagaaaaaaaacagaaaattgagaaaactcaatgaaaccaaaagcttgttcttaaaaaaatctgtaaagttgaaaaacctctagtcactaaaaagaaaagacataagttatgtatatcaacgatgaaagaaaaaatctctctaccaatcatacagacattaaaagaatgaggcaatatctggaacaactttgggcccatacatttaatgatgtagacgaaatgaacgaattccttgaaagacaccaaccaaagctcattcaaagagaaaaagatatcctgaattgttctatgcctacattttttacttattttatttatttatttatttttgagaccgagtctcgctctgtcacccaggctggagtgcggtggtacaatctcggctcaatgcaacctctgcctcccaggttcaagcgattcccctgcctcagcctctcaggtagctgggattacaggtgcccgccaccatgcctggctaattttttatatatatttttagtagagacgcggtttcatcatgttggcgaggcaggtctcgaactcctgacctcaagtgacctgcctgcctcggcctcccaaagtgctgggattacaggcatgagccaccatgcccggcctatacctacattttaaaaggtgaattcatgatttagtatcttacaacaacaacaacaacttaaacaaacaaacaaccaaaactctccaggcccagatgtttcaccagtgaattctaccaaacatttagagaaaaaataatatcattatatattctttgaaaaacacaagagaggcaggaatcttacccactcatttccaacaaatcaactgcaagaaaactatagaccaataaccctcatgaatacaggtgcaaaattccttaagaaaattttagcaaatcaaattcaacagtgctttatttctatacttgctttctgcatgaccaacactattctgaaaggataacccatcataaccaagtgggattaatccttgaaatgcaagattggcttaactataaaaaaattaatcaatgtaatttgccaaaatagcaagttaaaaggaaaaagccatataatcatttcaaaaagtgcagaaaatgcatgtgacaatatttaataccaattcataataaaagactctcagcaaagaacgaatagaagggaactgtctcagtaattgccagggcagggatggagggaggaatttaacttcaaaaagatacaaggcaacttcctggagtaataaaattgtcctacagcctggaggttacatgaatatatacatttgtcaaaattcattaaagtatacatttaaaatggtgaattatattgtacataaatcacaccaaaataaagaaactaaaagtaggagggtttgcatgtgcagcttcactctgttctgagaggaacagataaaagcagggcaagcatagaagtggagagccagttagaaagaactgcaatgatatagacgagagattttagtgcagactagggcagtggtagcagagacagaaagaagtgtacagactcaagctttattttgaaggtagaatcaacagactttagatgtgagggtgaaagagaaatagataaatccagagatcactatatttatggcttaagctactggatgattgtggtatcatttaatgatagagaatgtgaaggaaacaggttttgggagaaaaccaaaagtttgttttttggatgtgttaaatttgttaagtttgagatgtctataaaacctctatgtaaaatgtatatgttcaggagctcagagagaaagtctgggcagagtcttcctataggtgtatttaaacaaaaagacaagaaataacaggcctcagaatcaaggcttggaaaatgcaagccttgatttatgagtacaggaatctgggggaaaaaaaaaacttaagaaggagttgtataaaaaaatttagagaaaaactatgagtagtataatggaagctaaaaggaaagattttcaagaagaagagagtggtcagctatgtcaaattctgctgaggttgaatgagatgaggctagaaagatgacactgctgtgagttgggatgtgtgtgaaagacaagaagaaagcatatgtaactatctcctttcagaagttgggctgtgagcattctggcagaaaacagggcaatagccagaagagtattgggatataaaaatggtttgggggccaggcgcagtggctcacatctgtaatcccaacacttcgggaggctgaagcaagaggatcgctttagcccaggagtttgagaccagtctggacaacagagtgagtctctacaaaaaaaaattttaaaaattagctgtgcttgcctgtagtcccagctactaaggaggctgaggttgggggattgcctgagcctcaaaggttgagactgcagtgagctgtgatcacaccactgcactccagccagacaaagtgagactctgtctccccctggctccccctaaaaagaaggtgttttgtatatactgctttttttaggatgggtgatactaagagcatgcttttatactgatgaacatgatccagtagataaagaagaactaatgataaagtacagaagaaatgaagtactgaaaaagtcctttataatctttaataaaaaaccaatagatatttgctattgtctgtgaaagttaagagccatatcactttgagttgagcatttattctatttggcttaatttatattcttacatagaacaggatttcaaaggagatttgtaataaatatacataagctactagatgcactactgaaatagattttaaagaaatgggctgttgaaatgggaataaagttcatacacatgtatcagaaaagtttattacaatacagagctggggagatatggcagaggagctataatcagatgagttcaaatgggtagataattggttcattcaagatttgtttcaacttctttttagtgagcatggaatgtttttccatttgtttgtgtcctctcttatttcctcgagcagtggttatagttctccttgaagaggtccttcacatcccttggaaagttgtattcctaggtattttattttctttgtaacaattgtgaatgggaatttactcatgatttggctgtttgtctattattgctgtataaaaatgcttgtgatttttgcacattgattttgtatcctgagactttgctgaagatgcttatcagcttaaggagattttgggctgagatgatatatacaatcatgtcatctgcaaacagagacaatttgatttcctcttttctactggaaattttctattggaaattttctattcctctttcctctattggaataccctttctttctttctcttgcctgatggccctggccagaacttccaatactattttgaataggagtggtgagagagggcatctttgtcttgtgccggttttcaaagggaatgcttccagctttagcccattcagtatgatattggctgtgggtctgtaataaatagctcttattatttggagataggttccatcaatacctagtttattgagaggttttagcatgaaggggtgttgaatattatcgcaggccttttctgcatctattgaaataatcgtgtggattttgtcattgtttctgtttatgtgatggattacgtttattgatttgtgtatgttgaaccagccttgcatcccagggatgaagctgacttgatcgtggtggataagctttttgatgtgctgctggattcgatttgtcagtattttattgaggatttttgcatcaatgttcattagggatattggcctgtaattttctttttttgtcgtgtctctgccaggttttggtatcaggatgatgctggcctcataaaatgagttagggagaattccctctttttctattgtttggaatagtttcagaaggaatggtaccagctcctctttgtacctctggtagaattcggctgtgaatctgtctggtcctgggcttcgtttggttggtagactattagttactggctcctctttgtacctctggtagaatttggctgtgaatccatctggtcctgggcttcatttggttggtagactactagttactgcctcagtttcagaacttgttattggtctattcagggattcgacctcttcctggttttgtcttgggagggtgtatgtgtccaggaatttatccatttcttttagatttctagtttatttgcatagaggtgtttatagtactctctgatggtagtttgtatttctgtgggatcagtggtgatatccactttatcatttttattgcatctatttgattcttctctctattttttattagtctggctagcagtctattttgttgatcttttcaaaaaaccagctcctggattcattgattttttgaggggttttttgtttctctatctccttcagttttattctgattttagttatttcttgtcttctgagagcttttgaatttgtttgctcttgcttctctagttcttttaattgcgatgttagggtgttgattttagatctttcccgctttcttttgtgggcatttagtgctataaatttccctctaaacactgctttagctgtgtcccagagattctggtacattgtgtctttgttctcattggtttcaaggaacatctttatttctgccttcatttcattatttacctggtagtcattcaggaccaggttattcagtttccatgcagttgtgtggttttgggtgagtttcttaatcctgagttctaatttgattgcactgtggtctgagagactgtttgttatgatttctgttcttttgcacttgctgaggagtgttttacttccaattatgtggtcagctttagaataagtgagacgtggtgctaagaagactctatattctgttgatttggggtggagagttctatagatgtgtattaggtctgcttggtccacagctgagttcaagtcccgaatatccttgttaattttctgttttggtgatctaatattggaagtggggtgtttaagtcatccactgttactgtgtgggagtctaattctctttgcaggtctctaagaactttctttataaatgtgggtgcgcctgtattggatgcatatatatttaggatagttagctcttctttttgcattgatccctttaccattatgtaatgcccttttttgtctcctttgatctttgttggtttaaagtctgttttatcagagagcaggactgcaacccctgctttttttgctttccattttcttggtaaatattcctccatccttttattttgagcctatgtgtgtctttgcccatgagatggggctcctgaatacagcacatccatgggtcttgactctctatccaatttgccagtctgtgtcctttaattggggcatttagcccatttacatttaaggttaatattgttatgtgtgaatttcatcctgtcattatgacgctagttggttattttgtctgttagttggtgcagtttcttcatagtattgatggtctttacaatttggtgtgtttttgcagtggctggtactggttattcttttccatgtatagtgcttccttcaggagctcttgtaaggcaggactggtggtaacaaaatctcttagcatttgcttgtctgtaaaagatttatttctccttcgctgttgaagctcagtttggcggggtatgaaattctggattgaaaattcttttctttaagaatgttgaatattggcccccactctcttctggcttgtagggtttctgcagagagatctactgttagtctgatggggttccctttgtgggtaacccgacctttctctctggctgcccttaacattttttctttcatttcaaccttggtgaatctgacgattctgtgtcttggggttgcttttcttgaagagtatctttgtgttctctgtatttcctgaatttgaatgttggcctgtcttgctagcttggggaaattctcccgggtaatatcctgaagagtgttttccaacttggttccgttctctttgtcactttcaggtgcaccaatcaaacataggtttggtcttttcacatagtcctatatttcttggaggctttgttctgtcctttcattgttttttctctaatcttgtcttcatgctttatttcattatgttggttcaatctctgatatcctttcgtctgcttcattgattcggctgttgatacttgtgtatgtttcacaaagttctcatgctgtgtttttcagctccatcaggtcatttatgttcttctctaatctggttattctagttagcaattcctctaaccttttttcaaggttcttagcttcatcgcattggtttagaacatgctcctttagctcggaggagtttgttattacccaccctctgaagcctacttctgtcaattcgtcaaactcattcttcatccagttttgttatcttgctggataggagatgtgatcctttgtaggagaagaggtgttccggtttttggaattttcagcccttttgcgctggtttttcctcatctttgtggatttatctacctttggtctttgatgttgttgacctttggatggcgtttctgtgtagacatcctttttgttgatattgatgctattcctttctgtttgttagttttccttctaacaggcctctctgctacaggtctgctggaggtccactcaagaccctgttttcctaggtatcaccagtggagggtgcagaacagcaaagattgctgcctgttccttcctctggaagctttgtcccagagaggcacctgccagatgccagccagagctctcctgcttgaggtgtctgtcactgccgctaggaggtgcctcccagtcaggatacacgggggtcagggacccacttgaggaggtaatctgtcccttagcaaagctcgagtgctgtgctgggagatctgccactctcttcagagctggtaggcaggaatgtttaagtcttttgaagctatgcccacagccgcacattcccccaggtgctctgtcccaggggtatgggagttttatctgtaagcccctgactggggctgctgtaaaaggctttattttaaacatggactacaacactgtgaaagttaaaaaaaaattattttacctacaaaatgaaaaaaactcatgttttaggtactaaaaatatgtgttaataaatgacacatttctggataaatggaattatactttcattcaatgtaagcatctcaatataaatactctatactcttttttactagtagcaaataatgattaaaaaaacgcatccctttctagacaaggtttctaatgttattcagcaactcggcatactccatcccttctgcagcttccaaccatccactaacaaacaaaaaatagtgcccaacatatgactcatgagaactgcaagcaaattccaatgtcactaattcagaaaaccaagtgagaaaaaagtgttcagaaaactcagaatctgtactcaaggatgctattgaagccttcaaataagaaaagacatttctttaggaatactatgtatgttaaagactaattcagaaataaataagacagcagattagaatacactgaaagctcacaacaagggtaagagaaagaagaattacaaaaacaggaaaatataactacacaagtacaattgtgtgcaatcatttacacaaatttatctaaggtaaaaagtcaatcatagcatcgctatttttgagcacagtatatcatcagaggcttggacacttacagtccagccatcattttgcgtataagggaaatgtgaacaaacttgttaattacttgatgaagactgtacacaaggtggagaagttatattgatttttaaaaaatatatagtgcggctgggcgcggtggctcacgcctgtaatcccagcactttaggaggccgaggagggcggatcatgaggtcaggacatcaagaccatcctggctaacacggtgaaaccccgtctctactaaaaatacaaaaaattggctaggtgtggtggtgggcacctgcggtcccagctactcgggaggctgaggcacaagaatggcgtgaacccaggtggtggagcttgcagtgagccaagattgtgccactgcactcctgactgggtgacagtgcaagactctgtctcaaaaaaataaaaaaattaaaaaatatatatatatgtgtatatatacatacatatatacacacatacacacacatatagtgctattttagttattttgtaatccctaagaatatattagaaaatggtttgatcataatataatgacagaatgacatcctttttgtcattccattgattggaaaaacaaaaataaatgaaaacatttatttgacaatttgctaaggtattttgtaagcaaatattatatatttatgcatcacatttatgcaaaagtttccattttaattctgaataagaaaaatatcatttagtttactgcttataaacatgaaataatgtataagataagaaatagttaaaattaaaatgtttcctaccgataaataaatgagttaattaactttaggtatttaataaaaggaatgtattctaccacacctttgtaaaagaaccaagagtgattttgggaggtgcttaaagatatcttctacctaattaaagaaaattgaggatattttcacgtttgaaataaagctctccttagtttcgctcttgttgcccaggctggaatgcaatggcgcaatcttggttcactgcaatctccatctcccgggttcaagcgattctcctgccttagcttcctgagtagccaggattacaggcatgcgccaccatgcctggctaattttgtatttttagtagagatgaggtttccccatgttagtcaggctggtctcgaactcctgaccgcagcttcccaaagtgctgggattacagggtgagccaccgtgctcagccaaattttattcatgtttaagaaacttgttatgctctaaactttaaaaatattttccatcaagtaaatgatctgccttagtatacatctgtgaactggagtagctggagcttacaaggtcatttcaaatactggaaggaaatctagggcaaagtgtctaccaaggacttccttctatttctttccctcttgggcctattgttttaaaagacttcattaatttattaattaaaatgataaaacaaattaagatatcaagatttaactctcaaagacaattcctaggaagtatagaataaccagtgctatcccagcgtaaaatcctgaaaaagcaaaaagactaggtgtttaacctagcctttattcaacaggtcaatgcaagtcatgagaatattttattcagtgctcaataaaatattatgcaaattattaaaagaatggcattctaaaattgagttaaaaaagggtattcaccacatgggttgattgtagagctaagtgaagcaactccagtggaaaggccaccttttgaaactactgaagccacagaaggtgtcgaagatgaagttggtgtagtagaggaggctgctgaggatggtaaccgttctccagactccatatctatgagaagggaaaatgttaattctcagtatcagataaaaaattttttcaaaagaattcaacataaactttttgtatacttttaaaaatataaaataaatttctaaatacatgttctttggaaagagaaaatatggagtagataaaaacaatataatttaaaataccaacttatggaataagtttaagtataccaaatcctcttgagttttcttataccccccaaattaatagtggtttgaatatagtaatttcacacaaaatgtgtattgccacaaccataaattaacatgttatattcgtcttattcatcccaaattacctcacatcagttcacttgcaacagaattcctatgttaccttaatgaataattaaaaaaaaacaccaccacatttgaatggtctgcccccttatcttctaaatacagatagcaatatacttgtagctcttaagtgtccaagaatctggcctgggaatcccccccatacccctcaaaacaggcaaatacatttcagagtttaacttgaggcaagtttaaactatgatttcaaaatggccttagttgtgacccatttaaaatgacaaaagcacttctaatcatctttattaatttgttgggctttatggttgtagccttgcattggttttattgcaataactaatgctgatattaaaaatttggaatataatgggcattttatattcattttaatactctatgcatgcactgatcccacaatcaagcaagaaagtcattaaattcacagatgctttaaagagaacacgatctacaataagaaaaaagatactgcttgcctataaatgaatttatgatcagccacatgaaaactcttaccatttaaataatctaactatagaaagatttctgtattgaattctacaggcaactcacagaagaactgtatctttactaagaaaaatagttggatttcatttaaaaaattgactaattaaaataatgcaaggctagtgtttgcctaattgttgattgaatccataaagtatgtagataatttttctcataagataagatatatatggggaaggtaatcttaaattgacatgcaacatcattagaaagaccatttcaatgagccttctaatcatatagaattcaaaaacttctcttcatattctagtattgctgtaaatcacttccataaatgacagtactgctatgatgagtctgtccatattcttacagaatttgtatttctctttatcagcattcatcatgggaaaggcatagttgctactgatggctgcatgcaactaatgtttaaagagtaggttttgggtcagcaacagtaactaatgaactctgagacatgtggctgtctgatggtaaggcccataaaaattatttttaccaagtctaattttcactaaatacaaaaaatatggactctttacctagaagtgagtttaggaaaaagctattttttctttatagctggtaacctcattgtcttcaagaattctatctgctacgtaaatatactatgtaaaaaaaataatggaaggggtttaaaaaaatttgcctttgtactccacagcagaagtaatttggtgacataataagataagcactttagctgagtacttggcatataagagatcaatataaaatagtcattaactttttataggataatatgctatgaagtataggtatttcttattgttgataaaacctgattcaggactaaagtaaggaaaatcaagaaggcaaaagaagtagtcttgtatacatactgcttaatggatattactttccctgaagaattaatctgaataattatttaaataaacgcacatgcacaaatatgtgtgcgcgtgcacacacacacacacactcacagataaagtatcattaggtaaagtgatatatacaacgttgtttgctacagtactgcttaaaaataaaatttaaaactggcaatgagagtagaactagagctagtagtataggctggggccttttttagtttcagtaaaggtgtaattttttttcttctatatctggttctttttgctcatttaagtaagaaggggcttaacttcttaaaaacatatgcttatgtaaccattttccttagaagctctattatagacattattcatgtattattttatttcaactatatttatactaggtatttttagcctaagatttattagctggctgagtagtcttcttgcatgtaaagtactaattctctcatactggtcttaagtagttgttgtttttaataggcatttcttagttctaataaccaaaaattgggtcaactactgcaagttcatcttacacataccctttttttgtcattttatagaaatttaacaaatccactctagcctttgcactctagaatgaagattgtcttatgcctgaatttacaaggtttagttttaagtcttctttttaagttaaatattattctttcagttttatttactatcatcccctctaaagcacaagaaatcctggccatcaacttgatagttaaaaggtgagaaggcaatgcctttgtaattgtgaaattgtataactgtgaaaaatccacaaaacaatcattggcttaccatatcgtaagaactagtcaaagaacaggtatagatatgtaacaaacctgcatgttgtgcacatctaccctagaacttaaagtataataaaaaatatatatataaataataaaaacaaaataaaataatatgcaccaaaggttactaaaagcagtgggtcaaaatttgaggagaaacaggatatttgcatagtctcaaagtatctcctccaaaatatcaattaaatgaaaagatgaaaagaatagtttcacagtggagaaacaacattacctataacaaaatatcaacatcatgtattttctgatgccccagaagagtccatcacttctgtggtattcttcccaaaactacacaaactcagctgaaccatgagacaccacacagacccaaattgaaaaaccatatacaaaataactgactggtattcatcaaaagtgtcacagtcatgaaagaaagaaaaaaaaaaagactgtggaattgccataggttggagactaaggagactaggaattccttagtgtgagacctaggatcccacaactaaatgtgatgtgggatcctaagttggattttagaacaagaaaaggatattaatggcaaaactagtgaaaatcacataaggtctgtagtttagttaatagtattctatcaatgttaatttcctgatgtttataattttgataattgcactctggttatacaacttattaacattaggggaagctggatgaaaaatatatgtgaactctgttttttatttttaggtctaaaattatttcaaaataaaaagtaaaaaaacaaacaaaaaaaaaacccacaaagtcttccatatagtaagcactaaaaaaaaaatacatatgcattgaagttaaagagtataaaaaactaaaccttgaaggaatgaagaacagactacattgtgtcactgagatatttgctaataaacattatctgggttcaaacactgtgcctgaagtttattagttgtgattttgtaaaaattatgtaatttctctcagttctcaatttcctcatgagtgatttcaagaagatgtagttgggaggattaaatgagataatgcatgtaaagggtagagtacctagcatttaatacttgttagctattgtttttaatgagtgagcatctatgtatataattacccatgtgtatatgtggcaagaaaagaaacctcaaggtattctaaattattcatgttaaagtgaatatttaagagttatactatttatagattatgtatatccttaccatggaattatatttttagccagatagattacgtgctaagaatttaaaataaatgtctcataattgtaccgatatcaatgtggtaaggtacgttatcttaaaattttccaaataagctgatttttcatctataatacaaatacagatgaaaaattaatacattcattttgttgacaaaatatgttatcatgagttactatttataattcaagcatagtacataaaaatctgcagaaactcatttattcatatctttttagaaaaatatattcattaaaataaaaacagttcaggtatccaagaaccatctattcctagatttctgttagggccagagcatccacatctgacacctacgctcctataatggcctctcgttctgaccctttgtgttaagaatactcctttcatcttgggttccaaatgatcacgaactaacccattctttgtgttcaaaaccagcctagatatcacaggatcacaacaaatggagtataataacatgacctcccgtctataattcaacaatggaagaatatctagtaggtacatcttttaacttaaggccattcaagagattatagtttctaatgtataacttggtcatttttttttgagaacaaggtctctctctgtcacccaggctggagtgcagtgttgtgatcatggctcactgcagcctcaacctcctgggctccagtgatcctcccacctcagcctcccaaataactgagactacaggtacctgtcaccatgcttggctaagtttttctattttttgttagagacaggtttttgccatgttgcccaggctggtcttgaattcttgagttcaaactatctgcctgtcttcgcctcccaaagtgctgggatgccttatttcaaaatttaactaggcttggcgcggtggctcacgcctgtaattccagagctttgggaggccgaggtgggcagatcacttgagttcaggagttcgagaccagcctggccaacatggtgaaaccctgtctctactaaaaatacaaaaattagcaagacccacgcggtagtgggtgcctgtaatcccagctactcgggaggctgaggcaggagaattgctggaactcaagaggtggatattgcagtgagccaaggttgcaccactgtactccattctgggcaacagagtgagactccgtctcaaacaaaaacaaaaccaaaacaaaacaaaacaaaaaaatgagaagaaaagaaaaaagaaggttaactagttaaaagacgactataaccacaaattaacgcaaaacactatagtaaaaaaaaaaaaatgttgtgaaccatgggagaaatatgtgcaaaagatgaagggactacaaatgatttgatacattatagatgtttcctgtagcctaaagcagtgattttggttttctgacacaccatctcccccaccagggaacatatgggtgacattttcggttgtcacaactggaaaagtgctaatggcattgagtggagatagaggccagggatgctgttaaataccctaaaatggacaagaagaacagtcttcccctacagaattatccaaactaagttgttagtgttgctatggatgaaaaactctgatctaaaatatcaaaaagggtattatttgaaattcaactagctaaaactttaatagtaattctatataactataatagtaaggtgagtcaagctgattttgatgacccaaagctactgtaataagtgataaaattatactcaacatcttttgtgtcagcatccttctaagagtctaatatttcacattttatccaaatgtttaaacactgataatgtatcacatgtaattaacacacatcacaatgctcactcatactgggtaacatacatttgctgtattttactaaaatgacatttatctataacaattctgagcgcaaataaaaatccaaatttatgaaaatgacagaccacaacttcttccctgcatgatgattttatgtactataaaaggattcaatgatcagttgttaatgataatattgttcaagtttatgtatctcaagtattcctgttttgtgtaatcatagagttcatgaacactgacagctggtaggtgtaaacctgaacaggtgctaacagggagaccaagacacgttgcctgagatatgtaaacatgattagttccctgtgtttcaggtgcactgatactttagtgttgccatataccgtcaagaaaagcaaggtaataaaaaaaaaagtatagccacagattaaagatgcagaaattacaaataaaaatagacttagatatttttcctgaaaggactttttttaaagaatgattttatttgtactaacagtagcaaaagttatctgtgggagttcaaaacacagcagattcagtgagtccttacttttcctttataatgtaacctcagagaaatatgataattaggaagaatatcaggaggtagtcactatgctacttcttttggtttatcagaaccactaagagtagagttttattatacaagttcaatattttctaaaaattctgagaaaggtttacatataattatttgtttagacaacttccaggcaactgaacatttgaacatataaaacttcaagatattaaatagcaaaacagaaacaaaaaccaggcaacaaatgaaaaatcttctgttaaaggacattcagaaataggggatgtggccgaaataccttatcagacagcagacaaaattattctttgaaaataatatgttcataggaaaaagattctattcataaaatttttatttacctaaattttctgaaacagaatttcaaagaattaagtatggtatacagtggtttaaaatgtgaatatgtaaaatgaattgctttttttgtcatttgacacattttaccactataaacaaacaatttattacatcctcaaacagaactggctggcaaccaggtgttctgtgtgttaacctgtgatattcagcaagtttcagactcccctaaatactagtttccttacctaaaaaattatgagattgaattaaaccagctctcaagtttctatcagagttttacaaaattggtggttaaaaaacaactgacccccaaaaccaacaaaaaacacacacaaaattaatactgcattgaaatatttaacaatttaattccattttgtccttatcattcttttcattggcagtcttgattctatctccaaatgtgtatcatgttaaattatagatttctgttaaatcttttaaagatttactcttgttgtacttctatctcaaaagacctgatggtgagaaattatccaagggtaaaagcagtggttttcatattgctcagcgaataatctattcagagagtatccctttccatccaaaggattaaatattcctttgcaatgagctatctgtggggaagacgttatcctaagacttatgaaaaagatataaaagataataagagttaagaaagatttaatatctctatatcaactaaattgtaggtatagtctgtgaatttaaatactaactagacttagaaatgtctaacaaggaaacgaaggttagaaagataaagagagatatggtgtatggttagctgatcctttcatctacaaatccaaggggctccaaagaacaagcaaaagacctaaaactttgcttaactaagaaacacaattaaaattttaattagaatatttaagatagttctggaaagcaactgaaaccaatgcatgagatgaaaaaataaagcagagaatcaaacagaaatcatattactctatataaaatatccatgtatactcagaagcccaggaagcaaagtctaagtactacatgtctgatgaactaaaataaaaagtcccttttaataggaaagatgcagaaccatataacaggaacaatatacctcttaaagaacaaagtggggataacaggttgtgaataccgtgaaaaaaatgtgggcttttctttttcttcttcttttttttttttcttttgtgctggtcaccctcacattaggtttgtctttttagtattaccactttcctactcaaaagtcttcaaaggaatatatatcctagaaatatactcaaacacattggtaaatgtatacataaaggatatttattacaccactataatggcaaaagacttttaaaaacacatttccatcaataaagaattgttaaattagattttaaaaatctttactagattactatgcaggtgttcaaaaagaaagaggtagacctatactagctaatatgttaaatataaagagcaaggtggtggagactataaatagcaagatctcatttgtgataaagaaaaataagaggaagatatattcatatacttgtatgctcatagactatttctagaaaaacatgtaagaaatttgtaactgtatttacttctaggcaatggggaaactggattctaggatgggataattatttttcaccacatattttttctgcttgaatgttttaccatgtgattgtattaatgacagttaagtcaacaaaaagagaaagatttctaaaggtttgttattgctagaaattacctttcaaaatgctccagagtcttatgctacctttaagtcttaggaagcagggaacctactcccagtaaccttgaaatagaggctctagctctggcccacataccaactacttgtgtcaaggatcttcttttgtatgttttgtacattgtgattctatgtgagattttgtttaaagaaaaggtcccagtgcttttttaaaaaggtggtaaaccattggtttaatgaatatcagttctcactccagttcttaataacatgggtatctttctaatcctactcactgtgatgtcagagtctgaatcctcaccttcaagtaggaggcactttcactgttccctggtctttaatttctaatttcaaaccactgcccacggtatcttaaatcttatttcctcatggtgatcatattcctagttctgcatcctaaacatctagactctgacctgttgagtcaatcacctacttggggaggttttaagtgatttattttgttatctatccactattccctttccaagtttcaacaagagaagcaaacaaccagaagaaagaacttcagagcttgaagacaaggcttttgaattaatccaatcagataaagaaaaaaaaaaagaatttaaaaaaatgaacaaagcttccgaggagtctgggattatgttaaatgaccaaagataagaataatagtgttcctgagaaagaggaaaaatctaagtttggaaaacttatttgaaagaataatcaagaaaaacttccctggcctcgctagagatctagacatccaaatacaagaagctcaaaggacagctggaaaattaatcacaaaacgatcaggattacaggccacagcccaattggattttttttttaacacaaagaattggattttttatttttattttttaattttttagacagagtctcactctgttgctcaggctggagtatagcagtgcaatctcggctactgcaatctccacctcctgggttccagtaattcttccgcttcagcctcccaagtagctgggactacaggtgcctgccatcactcctggctaatttttgtatttttaatagacacaggatttcaccatgttgcccaggctggtcttgaactcctgaccttaagtgatccacccgcctcggcctcccaaagtgctgggattacaggtgttagctaccgcacccaccaataattggattgcttttaacacaaagaaaggataaacacttcaggtgatggatatcccatttaccctgatgtgattataatgcattgtatgcctgtatcaaaatatctcatgtatcacataatatatgccatgtacccacaacatttgaaaataaaaaagaacaaaaaaaagaaatacaccaaaatgttaacgatggttctcagaatggtgaaattataaatgactaatttgtttttatacttttcattggttttttatatgtttcagtctatttcaattttccacattaaaaaatattacacaaaaatgaaacacacccattttctgtttttttagggggaagaactaaccttaaaatttatatttagcataggaaaaactactgatcacaaggtgatcaacaatgaaatgagctattttacagaggtaaaatctatccttgatgatactttaggaagctgattaatagtcatttctccaggatggtccagaagaagtgaattagtcacaaactctggagcttcatttccaggtaccattaacctaaagagtcacaaaatttcagtaacactaaaaagaaataattttacattaaaaagccacatgtattttgagaaccaacctatcagtgttactggcctattcactaaccaaaaagcaagattctagattaactcataaagcctatttcctctcatttacgcttttcccctaataatgaagagacagcatactatccatggataggtatttcttgatgtccaatatgttacaccactgagtcgctgattattcaagttatcaagaacaaacttgatagaaatggaaaaacagcaatgaaatagaagacataaagaaaactaatagaaactttagaactgacaacagtaatctgaataaaaaactcacgaatggactcaatagcaaaatgaagatgataaaaaaaaagagccaatgaactcaaaggtagatcaatagaaattatccagtctgaacaacagacaaaataagcatcgaaaaacagttaaaactgacccagggacctgtgagacgataacaaaatgtctgagattcatgtcaacagaatcttaggggaggaaaaatggtgtagagttgaaaaattatttgaagaggtggtggctaaaaacttttcatttttggttaaagacataaaaacctaaagattcaagaagatgagcaaaccccaaaccggataaaccgaaaaagaaattgaaatctagactgaaatgccaggtgtgatggctcatgcctataatctcagcactttgggaggtctggtgggaggatcacttcaggccaggtgctagagaccagcctaggcaaattagaagaacccatccctactaaatttaaaaaaaaaattagccagccagtatggactacaggcacctatctgtagtcctagctatttgggaggctgaggcaggaggactgcttaagcccaggagttttaggctgcaatgaggtttggctacaccactgcactccagccagggtgagagtgagaccctgtctcaaaaaagttagaaaaagaaatctagacagaaatgaacaaaatggacaattttcaactatacagcttccatcaatttattccttgaaagtaagctgaagcttggaattacattatattggttttcacctattctttcttagtcaatgtcaaaaactaacttcttataatgttaattttttcctacatttatgacaaaatttcataaatgctagcgtctaaaagaatacatagcaaaatcatgctttaattctttttgtaaatactaaatttacttataattaataattcttaatcgagaaaccatacatcaaacagatatgaaatatatagatgaaacatgtaagatagtcaaatctccccttgttacacttttcaatccaagctttaaaaaatggtccaattattttaaacaaaattttataatgcagaagtccaaaatagcaatagaatctacgcgacctcctagaagtttactagcatgggtatgacccatctaacctaaaccaaatcttagtattatggtttcatattaacatttcacgttaactctttccagattgataatatcaaaagtaaaccttgacgttttgggttttagagtttttttgtttgtttgtttgctttgagacatggtctcactctgtctcccagcctggagtgcagtggcgtgatcacagcttactgactgcagcctcgatcttccctgctcaagcagtcctcccacctgagcctcctgagtagctaggagaccacaggctcatgccagcacacctggctattttttttttatttttatttttgaagagatgggatctccctatgttgctcaggctagtaacttgaaggttttaaaggggatataaatgctatagacacataaagaaattaacatttaacacacactgtgctttggttagcacattgcaaacctctggagctccagcatgcatccctggtcagcttccatttttctcagaggtctccattaacgtaggcaagattgacaacaaaatgcacctataacatgctttctgacattactggtcttgtctagaatgcatgaaaacttcccccaaaaacagctttttcagaacctattataaagatctgcaaaaacccagaagtttgcaggagtctattttatggctactattaagtttatataaattttacctgtttaatatgtctgagggtcatattaaccttaaaacaaaatttttaaagcaggctcacaaaaatttattctagtcctatcaacactcactaatgtatgtcctccctcctttagttggctattgatatcaataacaaggcttagaaatatgcaacaaccaaattgcttatagatttaaaaggtaatttcaaacattcccaatttaagtaatgtgcacttctgatgtttaatggtttctaaactaatgattgctagtttaacacgtgcctatctgctagaaaggaggtatataataatactagtgtttgggagaaaattaactctctaattgatgagtattaaaagtcttctgttggccaggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcccgggcgacagagcgagactccgtctcaaaaaaaaaaaaaaaaaaaaaaaaaagtcttctgttaaaggttatagcattttagagctctaaactgatattcaaatttttagcaatcatattactttaaaacttcccataggctataatagaagtcaaaattctcctattaataattaactattatagccaactgttgctgaagatagtcattattaccatcctaattcttctttttatttctctgacctgaactgtcatctaattcattcctctttccccatgaaccaattcattgacaaaagtcatgtggcagcacatatctattctcccattcgtattaacaacaaaattatactgaaactccttaggcttgaccttataggcttacttatttctcaaaacttactttctctgtatttccaatcaaacttaattagtcaccatcacctggttcttgcaccatactttcccaaatccttaattccaactgcatccctctccttaacatgttcttcatcccttgccccataattgcatatcaaatccttcctatgctttaaaccccaggtcaaagtgacaccatgaatgacacccctgacaaggatacccataaattacctaagctgaaagtcagatatcccaaacccttagcactgttgactgctgacaatttggagaagtcaaagttctaaatccataataaagtattttatcactgtctctttcactgcacttaccatattttatcctgtattacaactatgaacttgcatacatttgcctaagaattagtaagcttatgggagtagaaatcatgtttttagtatcttacatttcccagagccttagaggaatactttgcttaaaacagttgcttattgaatgtttgttgaataaatgaaaatgtgtcttcattatttatgtgccttaaattaatacttcatattttaaaacaaaaatatgacaagaaaaacagcaacactgtaactattaagttataaaatctggatattggagctagtattttatcaagtctgtttcaaaattatcacagattttaaaattcaaagaaaataattgattaaaaataattgtatttcatacttcaatgacagaagtcattatcaacactttcaattcaaactcagaattatagtatttttgttgttatctgtttttacatttgtagtccttgcttttaacatgtcaaaaatctcagttaatgtgccaacaacctctgtttttgacactttcggcaccaacactaacataataatacaattactgaaaacacagttcttttgatcctcaaaatacagtaaactagtaaaactaaaatatctaaaagtcactttaaacagttcttttgtgtggttataccttcaactagacacaaaatcaggtccactcattacatttcattgcaatttttaaggacagcattcaaccatacagcaagcaattcagatgaacccaaaatcaatgtatcaaaagtaatatctaaaagtgcactgtccaataggacagccattaaccacatgcagaaaattacatttaaattaattaaaattaaataaaatttaaaagtcacactagccatattttaagtgctcaacagctatcacatcattatagaaagttttatggcacagtgtctatctaaatgataatattcttccctcagacctgaaatcctctcacttagtgaggaagcctgtttcatactgagtaactcgactattaaaactgttaaaacatgagttggcagctttagggcagatactaccttattaaagttttcttcagaaagatggatgtgcagtattagatacaaatcagcagttagctctatgaagaaacttaaactaatatcatgttaccatgttttcttcacagggtatacttaccattactaaaatgttggaatttcattaaaatcagtggtagattacttgaggtggagtttagcttatttatattcacttaaaagcttaaactattcactcagaagataacctgaaataactctcattacatctttcattacttctcaaatgtttccactgaaatatccctagcacaaattggaagaattttgttctatttgcaatattgtaggtccaggttttactggcagaagaggccataaacatatacctgatataagtgctcaatgtattagttaaaaagaactgaacagaaaaaaagcagaaacaggttatgtgtgcatgggtttccctttgcccttccactgatgctgatgacactctccgtacagggagggtcttcaagagctggtaagaaactaaagcctaggtattccactgcccttttatacactaaagccgaggtattccactgcccttttatactagcacttgcattagaattccagaagggcctattactaggtaggcaaagcaaacataaataatatacaggtaatgctggctaccaactctaaaattttaagtcatttctattgactgaactctttagtcccagttacagcaatatttttaaaacttcgggtcataacccattcaaggtcatgaaatccacatagtagaatcataaaaaaatgaaatattctgggtcactctcagagatatttgaaaaacacatatatatttggtttcccagtaatgtatggtttctacagggaagcacagaaggattttacaatccctaatcatactagctgctatattaaaatgattactactatataaatatataaactactatttatacatataagtacatttatataaacatacacactcacatatacatgcacatactactactactacactagcagaattcaggctttctgtacacaattcactgatgagagcagctgtacaaaattctaagaattcctctagggctcggtggcatatactcttaaccttccagtctatgacaaagaaatatggagtatttaatttggctgggcacctggaatgccacctaaatactagtcttttattctatatactcaactaattaaagatacatcaaagttatttcacccagatgctctaagtgataattatacaaactttaaccatttatgaaaacatctgatgttcaacctttcagaaagcatttgccacaccatgaagcatgctaggcgctcaggatataatgaataagtcaattaggtcaaatacactacctcaagggtttatactctagagtaggttggagcaatagtggacctaatcaatgctgagttaaacagattcttactagtaagaaattgagctaagtgatagtacctgggtactaggcattagaagatggtattatataaatttaggaaatggggtggccttttcaggggccatatgtgtagatgagcaaacaaattaagaaaataagtaagatatgcagttggaagatattatatttattcttaattttgttaataattagggatatctatattaaaagttatgcattttctcatgctccaaaaaatataaaaacatttaatatgaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgcctctgcactccagcctgggcgacagagcgagactccgtctcaaaaaaaaaaaaaaaaaaaaaaaaaaaaaaaatttaatatgaaaaaagaaaatgcttctgaaaatagattgccatcttagaatccaatattaattatagatttagaatagtttttataatatataggacattatataattttaattatttgctaattatcaaatttatgattcatctttacttataaattttagtatctacaaagaccacatggtagtgttggagtaaaataggagaaacagatatgagtatctaaaactatatatacattttaatcgaagaagaaatactttttttttttttgagacagagtctcgctctgttgcccaggctgcagtgcagtgggtcattcggctcactggaagctctgcctcccgggttctcaccattctcctgcctcagcctcccaaggacctgggactacaggcatgcatcatcccgcccagccaattttttttttgtattttagtaaagatggggtttcacgtgttagccaggatggtctcgatctcctgacctcatgatccgcctgcctcggcctcccaaagtgctgggattacaggcatgagccaccgcgcccagccagaagaaatactttttaaaaaattaggctgagcacggtggctcacgcctgtaatcccagcactttgggaggtcaaggtgggcagatcacgaggtcagaagatcgagaccagcctggccaacatggtgaaaccccatctctactaaaaaatacaaaaaactagccaggcgtgatggcacatgcctgtagtcccagctactcaggaggctgaggcagaggaatcccttgaacccaggaggcggaggttgcagtaagccaagattgcaccactgcactctccagcctggtgatagagcaagactccatctaaaaaaaaaaaaaaaaaaaaaaaaaattaatgctaccagaatggcttgaacgtgggagggccgattgcaccactgcactccagcctgagcaacagagtgagactctgcaggaaaaaaaaaaaaaaaaagccagccacggtggctcatgccttaatcccagcactttggaggccaaggtgggcggatcacctgaggtcgggagttcgagaccagcctgaccaacatggagaaaccccatctctactaaaaacacaaaattagccgggcatggtgaggcatgactgtaatcccaactactcaggaaggctgaggcaggagaatcgcttgaacctgggaggtggatgttgcggtgagccaagatcgcgccattgcactccagcctgggcaacaagagggaaactccgtctcaaaaaaaaaaaaaaaaaaaaaaaaaaaaattaatgctaccatagttaaagaagagaattttgagaattctgataaaaattcaagaaaaaattgttacacattaaggatttattccttttttgcctcttgtgttgaaataggtggtgtattatttatttaacaactatttttgagcattaactacaaatctctatgctggtttagtcgttagaaaataaagataaaatcatagtccttaccttataaaagttcatcatttaataattctcactactcaattttctctaaatttcttttcatttaatactgttatctccataattcaacctaaatctcaattactataatttttttatttttctgataaacagaaatgtatgtgctcacttcactaaattcggagtagtgagaggggtacaaaggagatgcaaacacaaagattttggagacaggcagtttcactcatgaactaccaggaagaaaaaagatcttttgccttgatgtaatttttaaatgatgacagttttcataaaagttccaccctccacctccatccaggaagtaggaaggtccatgactcattatgctttccctgtgcttgactcaggcttcctctttacagactgcctaattcagcagataggacttcctgatgttgaggaaatccttgtctcttaacagtgggccacatggtcccattcctgtggtcaaagctgtctgaaacagatataacccaaggagacaagagttggccagaaatctatgtgtcagtggtctctaaaagattctatactctaatcagattctttctgatataaacattttcaatgatagaaacagggaaagtggttgctgagattaagagatccttaaggctgggggcctaagtatacaagtttaaaaaagtgggttggaaaaaaataatggaagagtaaatgtacagagaagttgagtggccttgagagagagagaagatactcttctgttactgttccctgccaacgaaagagcctagtagaaaacttcctaacaaatatgatgcttgtcttttctcatgttcactcatgctacttacaccactgagacatattctggttttcacttccaataatccaaacaatatactcctttaaatatacgccctagtgttcctttatccataaagctggatgtgactaaccttgggtcccaacttcccatctttgaattatggagcactttagcttctacccaggaagctgctaattgcatgacttttttacagctctgtatttgttttatgaatacactgtattattcagcacacaactagtatgtctgttgagctttggttgctgaatcagtacaatgaaactaattatgcttacttcaaagagttataaagagagggcctagtacacttcctgccaggtattttgttcttacgtgtttggccaggagaatacaaagaagaaaatattttctttaaacttatgatataagggtaaaaaaaagctcaataaaagtcaacattatttattttataagttaaatgtaagcaaacatgttgaaatgtcaagataattttcaattccaagccgatttagttcacaggtaaacctaaagaggtgttcaagagtatattaggcgatcccctgtcaatctagctttcaaaaatgccatctttaccttagctttagataatagtataatttgaaattttgttttagataatagtgacatttttattttagttcttagataactaaaatagtaaaactgcttttccctgagaagttaatatgtaattttataaccttcattatacacaaaattaattttgttcagactataacagtgcatttttcagtaatctagggaccaagttttctccttttgacattaataatctccaaatatacacaaaaagttattattataattccccctaccattctcttaagtataccatttggtcaaattatgtattaacttattgtttcaattatgcttcatccatttccctcataatttttattattttctgaattgcatacacttgtccatgtcttactgtacttactgtattggcaatacccaaatattaacataaataacgttgacttttattaagctgtttttctacccatgtatcttaagttggagaaaatattttctttctgtattctcctggccaaatacataacaaaatacctaacaggaggcatgctacaccctctctttattattatttttttcttctacttttaagttcaggggtacaggtacaggatgtgcaggtttgttatacaggtaaacacgtgccatggtggtctgctgcacagatcaacccatcacctaggtattaagcccaacatccattagctattcttcctgatgctctctctcacccccgtccccgccactccgacatgcaccagtgtgtgtatatctcctctttgtgttcacatgttctcattattcagttccacttacacgtgaaaacatgccatgtttgattttctgttcttgtgttagaatgctcgggataatggcttcgaactccatccatgtccctgcaaaggacatgatctcattccttttatggctgcatagtattccatggtgtatgtaccacattttctttatccagtctatcattgatgggcattaaagttgagtccatatctctgcaattctgaatagtgctgcaatgaacatacacgtgtatgtatctttatactagaatgatttatattcctatgggtatacacccagttatgggattgctgggtcaaatggtatttcagcttctagatctttgaggaatcgccatactgtcttccacatggctgaactaatttacactcccatcaacagtgtaaaagcattccttttcccctgcaacctcaccagcatctgttgtttttgactttttaataatagccattctgattggtgtgagatggtatctcgttgtggttttgatcagcatttctctaatgatcagtgatgttgagctttttttcatatgtttgttggccacatgtatgtcttcttttgagaagtgtctgttcatgtcctttgcccactttttaatggggttgtttgtttcttataaatttgtttaagttccttgtagactctggatattagacccttgtcagttggatagattacaaagttttctcccattttgtaggctgtctgttcactctgatgatagtttcttttactgtgcagaagctctttggtttaattaggtcccatttatcagtatttgcttttgttgcaactgcttttggcattttcatcataaaatctttgcccatgcctatgtcctgaatggtactacctagattttcttctagggtttttatagttttgggttttacatttaagtctttaatccatcttgagttaatttttgtatatggtgtaagaagtggatccagtttcagttttctgcatatggctagccagctctcccagcaccctctgttaaatagggagtccttttcccattgcttgtttttgtcaggtttcttgaagatcagatgattgtaggtgtgtgatcttatttctgagttctctattctgttctattgatctctgtgtttgttcttatacctgcaccatgctgttttggttactgtagccttgtagtatagtttgaagttggggagcctcccgtgatgttctctttgaagtgatgcctccagctttgttctttttgcttattgtattggccttctctttattataatattcctagtttttatatggaagaatgaagaccctctgtgacaatgctcagagaaaataaattccttcatagtacaaggccctaagtatacatcctaaacatgtcttaatatcacctgcattaaaatatgaaaacagctgggaggccaggtgcggtggttcatgcctgtaatcccaacactttgggaggacaaggcatgcagatcacctgaagtcaggaattcgagaccagcctggcagactgggtttcacccagtctttactaaaagtacaaaaattagctggatgtggtggtgcatgcctgtaatcccagctacttgggaggctgagtcaggagaattgcttgaacccaggaggcagaggttgcagtgagctgagattgcgccactgcactccagcctgggtgacagagcaagactctgtctcaaaaaaaaaaagaaaaaagaaaaggaaagaaaacggctgggcacgatagctaatgcctataatcccagaactttgggaggctgaggcaggcggactgcttgagcccaggagttcaagatcagcctgggcaacatggtgaaaccccatctctgtttaaaaatatatatataatatatatatatattttatatatataatatatataaatatataatatatattatatatatttatatataatatatatatttttatatatattatatatatatttatatatatatatataaagtagctgagcatggtggcttgcacctatagtcccagctactcaggaggctgatgggggatgatcacctgagcccagggaggttgaggctgcagtgggctgtgatcatgccatgcactccagcctgggtgacggagtgagatactgtgtcaaattcatatgctgtacacatacacacacactgtgtgtgtgcgtttgtgtgtgaaaacattcaatggttaaacacagtgatatcatgaataaaactatgagccaaaaattttttagtatttctacaaagtaaaacaaagtacaaactcagtaataaaattattctaaaaatgaccattaccatgattttacactttttaaagtatcctttataaacatagttttctgattactaaaattaatgtagtcttatgataaaaccatatatacctaatttaaccacaaaactgtctgtactttaaatgatcatctaaatattctacttcaaatgttgaaaagttaagaatatctgagttcctcaaaaggctaaacattaagagttactgtatgacccagcaattcaactcttaggtagaattctactcctattcttggacatataacctaaagaaatgaaaatatatgtctatacaaaaactggtacctgaatgttcatagctattgttcataatagccccaaagcaaataacccaaatggctatcaactgatgaatgaataaatgtggtatatccatacaatgaaatattattcaacaataaaaaggaataaagtgatacatgaagcaacatggaagaaccttgaaaacaccgagctaagtaaaagaagccagtcacaaatgaccatgggttacatgattccatttaaatgaaacatccagaaaaggatactctgtagagacagaaaatatagaactatgggtaggttgggggaaaatgaagagtgactgctaatggatattgggtctgtttgggggattatgaaatgttttaactgattgtggtgatggttgcacaactctgtgaatacactaaaaactgaattgtatactttaaatggacaaattgtatgatatatgaattatatctccataaagctgttaaaaaaaaaaaggctggcaaggtaatttacacctgcagtcccagcactttaggaggcctaggtgagaggatcccttgagctcaggaattcaagaccagcctgggcaacatggcaagactccgtctctcaaaaaggaaaaaaaaaaaaaaaaattagccaagcatggtggcacgtgcttgtggtcccagattcttgggaggctgagacaagaggactgcctgagcctgggagactgaggctgcagttagctgtgatcgtgacactgtactccagcctaggcaatagagcaagaccgtctccaaaataaaagaatatctgcatctctcaatggtactcaatgacagaatgccatttgacttaatgaattctctatgggaattttaaattcaatattcttgattctagactctatatccaagaccaaatgtagaatgtctctaatatgatttttcatgtgctataatgaatgatatgctgagacagaaaatcaagtcacatactcttaccaaactctctcaggtgctcgtccatttagtaatcttgcacctccacattacatatactttttaaaaacttggtaaagctatattaattcagtttggggactaacaagtttatccaatattaaaagtatatatatcttctctctattcccaccatcatcttaatacaatcctgaatcagttcttattggaaataatgcagtagccttccaagaggtctctgcttctctttccttcaatactgtttctaccaagagtaatcctgttttttttaaagcagtaatctttttaatataaaaatctgatcccaccactcccctacttaaaatctttcagtgtttctatatcacctgtatgataaaatcccaggtcttctgctaggcataacaaggtctacttaataagcctctggtttctttggtctccttttccactctctactcatacattaggtgactaaacaacttcttgccattcccaaatacaccactgtctcctcctgcatccatgctatgtttttagtgcatgatgtttgttctccctcaaatgccctgcccttattctctgccttactcctacatatactctaggtctcagctcatgtgtaacttctaaggaactgttccgactcacaaggaagtcttaggtcctttcctgttaatcttgtgtattccctaattaagtcacttataacattgtactatataacaattttttattttttatctgccttcttcttttttatttatttatttatttttgagatggagtttcactcttgttgccctggctggagtgcaatggtgtgatctcagctcactgcaacctccccctcccgggttcaagcaattctcctgcctcagcctcccaagtagctggaattacaggtgcctcccaccacgcccggctaattttttgtatttttagtagagacagggtttcaccactttggccaggctggtctcaaactcctgacctcaggtaatccacctgcctcggcctcccaaagtgctgggattacaggtgtgagccaccgcgcctggccgatatctggcttcttctggcaaatcagaaaatctcttcaaaagttcccacaaagtagtgaattgaataaaatatgccaaacatctatattttgctttaatgttttctgaatatactgtaaacttagtaaggcaaaagcataaatgttgattagtatatttatcctaacattaaataaacatgacttgcaaagaatattatacaaattcttctgataagagatgcatgttggcacttaggcctcttaattttttttttgtaatacttctttattttatttttttaatttattattattatactttaagttttagggtacatgtgcacaatgtgcaggttagttacatatgtatacatgtgccatgctggtgtgctgcacccactaactcgtcatctagcattaggtatatctcccaatggcctcttaattttaataaagtgttgaaaccttaaaaattttttttaagagatgagggtcttaccatgttgcccaggcccaagtgcagtggatattcacaggcagaccctagtgcactttagcctctaactcctggcctcaagcaatcctcctgcctcagcttcctgcgtagttgagactacaggcacatagcactctgtccagattgaaccttaaaatttaacttgccaaccaagaaatctatttgtgccaataaactctgcttttccatatttatatcaaacttctcaaattcactaaaggcagggagttaggcaccactagtttatttgtgtaagctaattttattttactaaaaacacatcaataccttgggattaatccagtcacatttggtttatcagtcccatattgaacatccttctctcttaagacatatattggaatctcataaaaggcaaatagggttctactcagcttaaaccgtaagataatttttatataaatatgcaatactatatacaaatacataaaaacacaagtccagaacattcctttagctatcaaagttctacatgaacttatttggttctctagttcaatctgtatatataagctatattttaaacaaaggtgcagagagcaattatctttcacaatctgccttagatgatagaacttaatttataaagctacatatttattatataatcatgctcaactgattttaatcttgatggacaaagaataatattatgaaaatgacttatgcaatatcttcaaataaaagtaataagctcattgtaaatggaggtagtcatatacttagagaaaacttgaccaataaaaatcttaatttagaaaacagtgaagcaaagaagtatatgtaatttcatagaagagaattccagcagagtgtcatctcgtagtttttcaagtattttctgagtgtaaaatgaattttttacttcataaacaagtttaccatacaattcctttaatgtaatgattcacaagcctggctgcatattagaaacacatgggggatctcaaatatatataaatctgtgacaaggcccatctccagatcaattatatcagaatctctgggggtggggatgtaagcattaacaggttgggaagccctccagaagattccaaggttaagaatcactgccatagagcttttataagcttcactattgccagattatgtcaattttgaagttcaaatgaaaataataactaacattcactgtcttgttggcccagtacttaatattaaagatgctataagactcactaaaacaaacaaaaatttaaaaagaaagaaaatatctgctaatataagggaatgggaaaatatctgctaatataaagaatgggaaaaatatacagatagcttggatgaaaaggtcccataagaaggcggcaagaatatagaattcatcatcatcttaagccccaaaagccaagtaggaaaataaaaggagaacaattcatacaagtaacagcaggtatgtgtataaggcagcttctaaaacctgaaactgacaatgaaagacttgaaaaataattggctttactgctaactgaggctctgaatagttacacattggcaagctaagcgtataatacattataaactatctacccggtgtccagatgagcactcaggatgagaggtaacaaggacagttgtgagaactcccagctatcctcctgtcaacaatgacagagaatctgaaacggatctctcctttccaagagtcttctgcccctcccaaaaatctcttacaagggctggctggcaagtttactataactagagtaggcatatggaaaggtggtagcaggacctccacccctccgaaaaaatttctacaaggacatgtgactacctgggtaaggctctctacccatgaatcccttgctaggtaatccttaccatggtctattgcttcttgaggctctacctcacctatatccagagcgagccaggatgacaggagggaaactggacctagcaatggaacctactgacccagctatccaggagatctgagctgtaatatgctgtattacactaggataaatgaatatccacaaagttccatttcaacatcatgtctaaggaatgattaacaagcagatttgaacatacagatacttattaggaaatagaaaagcttccagaaagggttgatgtagacttctattagctgcttagatggaggaatatctcctggtacttgggcagtaactccgcaaagaaccagatcggcccagtccagaaaaactccaaactttcaggaagattactatgaatacttcaggcacagcttagaaaagcttaaaaaagaaagcctgcgtttcagaaactgtgttatctataagaatacaggaccaacaagggaaacaccattaccacaatgtcttttctcctctcagtttttaaccctgaaaactttccttttgggatcacaaacaaataatagagagtactgagttcttttccaccctcagtaatttgtgtcctagagtgaaaggaggataagaaaaaggaaaagagaaagagtaattcaagcaagagaatctaacaagcaagataaactatccaaagaggtcagagtctgaaaactggcactactggtgggactgatgaataatccattactcacacacaaatctcttgttcagtgtcaggtgcaatactttgtggagcaggtcaacataaaagtaatggtacttctactaagttatctaaactataattataaaagttttagattcatggggccccaaaataaagtctggtataattacaaatcaaggccttctgaaaaatgcttagatggtcgtcaaagagagattaggtggctgcaaagaagagctaaatggttttgagaacaaaaaacttgaggtttcctgtgtaaaatatagcctgatacattaaagagaagtacaaaacttgaagaaataggctccagaaaaagtttattaggcaacagatcaacagctgatttagtaatgaaagttaggcttcaaacaactacgacagtgaggaggttaaaaaaaaaatctaaacaattatatctagaaagaatattaattccaagttttgggtgaaaactaagagttggaaaggtgtttctttgaagagaaaagcagtggtctccctaaaaaaatttcatttgaatttcacatatactagaggtccagaaagttctaaggtattaagggtttttgaatgtgtgtctgcttgtgtataagggattaatatgacttcggaaaatttgatgtatttttcaatcaatgcactaaaacattaggaatcaaattagatctaggattcattataatcttcctaccatgagaagtaatctaaattgaataaccaaaaaactttaaaataagaaaatgagaagggacaaagtgggtaagagttatactaaaggtatgattacttttaaaaagaaggaacttaaacgttttaaaaacggaggttcaaaagagatcatgttgtttcaaaatggaggtagagacgttttgaaataaaaataacagcactacgtaagttacttatttatttatttagagtctccctctgtcgcccaggctggagtgcaagtggcatgatctcagcttgccacaacctccacctcccggttcaagtgattcttgtgcctcagtttcccgattagctgggattacagtcatgcgccaccatgcccagctaatttttgtatttttagcagagatggggtttcgtcatgttggccaggctggtctcgaactcctggcctcaagcaatctacccgccttggcctcccaaagtgttgtgatcacagatgtgagccacaacgcctggcctatctatctgatttcaaatatgggctattatacagcctcataaatagaacttccatcacaagttcagcaggttccttgaaatggaagttggctttgacattttcttatcctctttaaattttctatttcacttaatttttagtcacagtgacttcttactttcttgccagatcagcaaagtcaaactaacaacatttaaactacttatctaattactgaatttgtattcggtaagttattcagagtatttagtttgttacaattatatgctctatagattattgaaattttgcttttaaccaagtggaaacttatttcccaaaagatttctccaagtctaacttttgttaatgatttaaacaccctataatctcattcccagttcctacttaagattcaaattcatattaaggcaaattgcctcagaggtttgccaaaaataaaaaaaaaaattccatgagctatccatgtcagtttcttcaaaattgctggctatttcaatctccctatgcattacatactctcatgtataccccctgaccagaaatttaaagaaaacttccaattagttttccttttatttccagaaattactctccgatgtcctaaataatattgtcatcaggatgacccattatatctgttattaccatttatttccttattgaatccacaagtggtaattcattactgtttgtgggtttgtgatattatatatccctcttagggaaacttgtaattaggtcaaagtttccctgttttaatattgctccccatttcctcactcttataaccttatcaagccagtgaaataatccctgccttttggcttagtggtccctcactgatctatgaaaagataggtaaacattgttctcctaatccatattgaattccagaatttatacttgtaagagtgatctcaaaaatgctgaatgaaatcattatagtcctctctctcacttataaaatataaaatattaacatatatcaaagaaaataaattgactaaaaagaatatattggaaacactttccagtcagatataattcagtgattttatattataatgcaaaaaaggcaactaatagatatcttaaaaatgggcagaaatacacttttaattctaattacttgtggaaacatccttttataacattgttcctagggactaagaaattcaaactcaacgaccacttctagaaaatattacaaaactggggttacatacaaccagaaggcttaattattttttaaaagttcactttaagaggtggctatttacacatacatatgttttcacacataacacatatggcttttttcctctcttttaagaaaaataccctgtatgtgctgaagccagtattcattcagcctaatcttttacattcactatacagtgtaacagaataaaatcaatgcttgattcagctatctggaaacagttttgtggttcctccaaaaagttaatgtaaaattactacatgaattgaaaacagggacttgaaaacatacttgtacacctatatccctcaaaagatgaatgaataaacaaatgtgatatacatatatacatatttaatatgtatttgcatatatgtacaaacatatgtatatatgtacatttgtatatatgtacaaatatatggatatgtatacacaaatatatgtatatatgtacatgtatatatgagcaactgtgtatatatgtacatttatacatactagtgtgtatgtataaatgtacatttgtatgtatatatgtacacatatacatatatctataaaatggaactataaaaggaaatgaagttgtgctacatgctataacatagatgaaccctgaaaactctaaagtgagataagcccaacccaaaaaaggacaaatattgtatgattccacttatgaaaaatatgtagaagaggaaaatttgcagagatggaaagtagattagaggttactaggagatgggggatggtgagggaaatgggaagttactgcttttttttatttttaaattttttttgagacagggtctcactctgtcacccaggctggagtgcagtggtgcgatcacagtttactgcagcctcaacctcctgtgttcgaggcctgagtagctgggaccacaggcgtgtgccaccatgcccagctattttattttatttttgtagagcaaaggtctcactacattgcccaggctggccttgaactcctggtctcaagtgatccttgagaccccgtctcagccttccaaagtgctgggattcaggcatgagccactgcatctgaccaggagttattattacttaatggttacagagtttctgtttgggatgatgaaaaaattttggaaatacactaatgatggttgtacagcgctgtgaatgtaattaagaccactggattgtgtagataaaaatggttaaaatgacaaattttatgttatagatattttactgcaatgtaaaaaaaatgtaatataccaaaatccattaaactatatactttaaatgggtgaactgtatggtatgtgaattatatctcaaaaaagctatttgtaaaaattaatgtttgaagtccttcttcagtgcttgaagatactgttctagttccttttccttaaaggagctttcctggtcattccaatgaccgctctcttactgtcaactcataatattttacttacatatcactcattaagcaattaatcttatgctccttttgacatctctggtttttttaattactgtaacacatttaatatttgattacactttgcttataaaactagactggttgctcaaattatcaaatcaagactcatttaatatttgtttatactttatttaccaaactagattagtaatagcgcagattgtcaaatcaggacccagtagccctctatgtcttcaaatcatcaaaaaatattcaattttatacttgcacaaatacatcaaattttaataatgttaagacaaactattccagaaaaaattaatcagaatactcattctctggacatttctttctttctttcttttttgagatggagttttgctcttgtcacccaggctggagtgcaatggcgtgatctcagctcactgcaacctctgcctcctgggttcaagtgattctcctgactcagcctcccaagtagctgggattacaggcacccaacaccacacccggctaatttttttgtatttttagtagagatggggtttcatcatgttggcaaggctggtctcaaactcctgaacttaggtgatccacctgccttggccacccaaagtgctggcactacaggcgtgaggtgtcgcgcccagcctctctggacattgcaatttataaaggatgtaacagatttagttcagtataattatttaaaaataggcaataataaaatactttgaacagaaatttttttctgatcaaccagtcatttctttttccccaactgaatcaaagacattgtccaaataaaacaaattttaaaactaagtgatacacaaacatttaacacatacactactatttttatgactaagtagaaatgctcaggaaatataattttaatcataagtggaattaattaaaatatgaaattacatagataacttagttaaaataaagaatgttgtaggggtcaaacaacatttttgtttacttaaataatctgtttaatgattacagtgaccataaaataagttatacctaaagaagtctttaagtcatgataataaaataaaaggaaaacttcagagaaaggtataggaagaatgaatacatcttttttgttcctttgaaaaaatagcataaaattttgagaaatgtatcaaaacagcagacttggtgtaaagtcatgtatttatagaacagaaatatatagacaatgtaaagtttctacctattccctcagtatatacttaaaatgatcattcagactcatatcctattttaatctacaccaggtttttaaaaaaactggtatttctgtatgtttgacatggctttgtaaaaatatttctttcttgcagtttgtctgaatgacttgctcttaagtatctttaaaaacatcataaatgtaaacagtattaattcacatgaaataacttctatttcgatccagaaggcaaaaggtttaagtttttaaaatatggcattgtcacctcaaaagtaagtatgtttcaaagaaaaaccatatttttattccctactgaagttgaaccacttacgttcacttttacaatgaaaatacccagcggcatcttagagattactggttttccagtaagaaacatagctatttagcaaattcacttgcctaaaaaacagccaaaaaaggaaaagaaataaagacggtctctaagctgataaaatgtgtggattaaaactcattcttcattatttagaatgtctttgtgcccttaatctttgaagttttataatttacacatgattccaacaagcttgggttcattcccaaggtcacagtatagtacaaacaaaaagatgatgataatagcagctgtaattttctaagcacttattaagcactatacacagggatgggaaccaggagtagagggagtgtctctaataggtaactatactgaaagctctgtagttattcaaagaacaacaacaaatggtttgactccttgatcaagaatctaaaagccttatgtcccaagggtatgactgtgttacactacagaatgataactaacatttaaaaaagacaactccttgtgacctcaaacagaagtctaaaaaatttttaattttaacatcatacatttttaaaataaggagcatgatcaatggaatctaaagacctggatttgaatccaggcctatcacctaatctatcaatgaccttagggaatattaatctccctcatactcagtttctccaaatgtaaagcagaaatactatttacatgacagtactaaagtgagaatcaacatatgtaaaagcagatagtacaattcatgaaaacagcagtcaatgaaatactcttaaaacttgactacccagaataattttgttctttgaaatatttttgttactttttaaatgtttttacttattagatgtttagctgttactttcattagtaaatatgtaaagtagataatgccaagattcattcaagtatgtagcaaatgctctcaaatttcactataaactacctgtttgactaagtaagtccaattcattcttcagtctcaatttgggttgtacccactctgtaaagccttctcacatctccacttgcatatctaatgaacattttggtctaccacatccaaagtcaaagtcctgattcttcatcctcatcccacaccttctccacctgaaattcttccctatgtcacaggtgatggcaacaccatccttccagctgccaaaacccttaaaatcatcttttctcctctttccttgtatctcacatccagcccatccagaaatctttttggttgtacctcaaaaacatccagaatttaactgctactaggccactaccttctctcatttagattactctaagaaccttctaactggtggtccatgactccttacatatagtctattctaaacatagcagctggagtgatcctttttaaaaatactgaaagccctggagtggctcctcaaagtccccactgaggccctacatgaataacccactcactcatttcctttgacaatacctcctcttactctctctctccatacccgtactcacaatgacaaccattcatttccctgagcaaaccagtcatgctcctgcctcatgccctctgcctggaagactttccaaaggtatccacatagctaacttccttaatctttcctcaacatcatcttttttgtgaatccttcctcagcccctgaatcccatcatcacctaaccttcacatcctgctcctttttctttacttcataacatttgtcatcttctaaaatgctatgcagtttatttattattattaatctccactcctactacatgtgccacaaaagcagagacctttgaaagtttcatttgctgatatttcccatgtacctagaacaccacacaaatatgcaaattaaatacggaaataaaacaatacattggatatctctcctttgcgtcacctttagcattctgtactgacctatattttatcagttatcacattgtactgttaacagcctattaattttctgcctcttccactagactgcaggctccttgagacaagggattttgtactgctttataatgctattgcctgtaattccttaaagtgcctgatacttaggcattccataatatttgataaattaatgaaaaaaataaaaccatccaaatcaagtgtgtaagcacctttactatctccaaaatataaacacaatggttaagggtatgacactggagactgttctggattctgaattgtgttagtgttttcagtctggctctggtatttactggctaaggaccttaatcaaattatttaaattctctacaattactttctcattgataaaaatggaagtaataatggtacctccacctcatgtgattatcatgaatagtaaatgacaaaagaattagcccagaggtttgcatatagtaagtattcaataaatgacataaattacttattataaattaaaatagaggcactattataacttttactttgataacttgactaagctagaatactcacaaacttaacctttagaatctcctcagaatatgccagtaatttatatcaaaaattactgagttacctaaaataaccctgataagcattatgtgaaagaaactaccttaattctttcaacaaaagaaggagtctatttacattatcccattttttaacattcctagatgttaggttctataacattcttcagtaactacttttgatttttcataatcttatgttttctttttatataatcaacatacctaatactacagtttaaaaattaaacatcttactacatagatcacctgcacttatatgtccataatacatatatacatacattcttccctctactctgaacaattttacttccagaaataagacttttgagaaaaagttaaataattttaagtatatttgtcactctttactaaatcacctttaagctttctacttcccatttcagtcgtgtatccaacaacatgtatattcctatttatattcctttggtaatattatattaaagattgagcaaaactaagagttctgttccaaattaaaaagccaatgtaatggtgtttcttttaaagccataaattttatttatctgtctattgttactgcaaatgttttcctatgtgcagagtcagttctccattttataaaatacttgtgaaattcatttcctttgtagtttgtaacactatacagaaataaacaaacatacacattttacttaagcactcacacagacagtagacaagacaactgaggtaagcagtttaaatgattgtcccaagaccacagatggagtgacggccagatttaggattaaaactaagaagctcattattcccttcttatattctgaatacttaacattgtttttatatcataaggatctctttgctaatttaagaataagttaatttcataattaaaattgagatattttgagaatatgtaaatagaattatgaaacttactaaatcaagataaaattagagtttatccaaagtctctgaaaaaaataatctttttactacataagttatttttaaaattttgtttagagtggcaagaaagtggcagcttaatatcatttatcatttcaatgtctttatttaataaagctaatttctttaaccaaaacctacagtatgtgtatgagctggttggatttaagataccaaacagaaatactttttcattttaaaaaatcctccaaacttaaacagtagtttctactctaattgtaaactttaacttcaggatatatttataagagatctatctatgaaaaaacaatgttaaaaagtaaagaaaacaccaaatacccttgcatttacaggagaaaaagacatagagtataacattaacagcttactgtggagagtgggtttaatcaggaagtagccattatcctttcgattcagagcagtgacagcactccaaaacaacaagccgtgatatttttcagttaaaaggcatgaaagaatacctactattgtgtcctagctttgctgaccccaagggtcagcatatgtcttttatcaaaagctatcatgaaaacataatccaagtaagcatttacaatgctctatttgttgaaacacctaaaatctacctaacacaacctctctctctctcagttactcacaaaacatggctgtcttattcagagattagcaattattgtaatgagatactgtcggagagggtcaaatagtacttcctgcagtttacacatcttgatttcctggtaaacaaactgaaaggcaggtggagcacttagatcaccagcaaacgtgaatgctcacgtgataaaactaagccaggtaaggttgatgtctcaagtaatcgttcttttcttaattttattaatgtcaaacagacaataaagagaagaggtctttcttcctttttaaagaagggtttactcctcacataaactcacatgataggaatgcttgaaaactggcactgtttaaaagcaggtttcaaaaatcacttctggcagataaactataaaaacaaagcaatgctaacaaataagaataactgctcaaaaacctgccaaaaataaagaaaagtctttaaatttcagctgctacaacaaagtacacaaaataaatttctgagttataataaaagaccaaaattaattgttttgtggtcaaagcatgtctatttttttatttggacaacttcctgcaaaataagactgctttataatttatgtggcagtctttgaaaaaaaaattcctatgatcagaaagtttacataatttgaaacttttctctacatcattttaaactcatatatcaaaaagaaaacaaaacaaaatatttaacctgtgagcattttttaaaaacattgttagcttgaaaactaagtttctttgtccatagttttttttttccccccaaattgctgttttttcactctctgaaatttttagtgtagtttgatgagggaagatttaaattagccatgggtatcaaacaaacaaaaaacccaactccatcaaaatgataaactaatttactacttaaaaaaatctagataattctgtaaattcataaaatttgcatttatctttaaaattctatatttactaaggccatgcatcaatatcctaactatttagaacaagtaagatttaattttaatgcaaaaagctcttaagagcccgttacaacaatataatcatgttaagatattaaaattatactacttaaattaggtttgtatttattcattttgcaaaataaagttataatgcactgaaatagaacaaaacagaatgataacaaataacaaaaagaacacccaggagagaagactgtgccaagggtatagaatctcagaacaggtctcattacatatacgtaatatgtcatttcaaggagtatgtattcggtattgagccacattaatgcaagttgctaacatcactaatcaccacctttactacaatgacacatgaaatagcaagttttcaaaaaactacaactacgaagttaacatttccagctgaatttcttggtcacgttaacattaaataatttaaaaaccatagtagtcacatggaatgcaaaacacagttcttatttcctttatagaaaatttgagatgtaattcctaccacataagtagctttgagtatgtaattcatacaccaaaacaaaacaaaattttaaatcagaaaattattatttcaattgtttcaatgatttatgaccatcttagtttcctataatgtgtcaaatttagagcacgatgaaatgaaaacataaagaggtacagcaaataaatttgatatttggtttcactgaaggtggtttttatcaagaggcagtaacttttgatattatgagtttacaattcagttaaaaggtaaggaacaaaaaccagttggaaaaagacttgccctcagagctgacaaatgagaaaaatatatcttttccttctcttgggtatatttcagccctacttatcctctgaggcattctttaactggacctggtagtgctatacagacaaaaagcttcagagtgaattcccctgtactctggaaagtccaagaaaccacagagctcagtcgtccatattaagaactatgtgcaaaatgaggtgggaaggcagagggagagacaagaggaggaagaaagtttcctactttttgcttgcttgccttctgctacaataaataggtgttacataattatttatatcccatcttattccaacataatttaagatgacttacaaaactatgagtagaagaacagaatgccgtctttaaaactaatatgaataaaagggaaaataagaggacatgagaaagatgaaaacacaaggtaaagctggaacaaagaaacacctatcgtaaggtcttgcacaagtctatgatgtgggtggttcagctccttagcaatcaaagtgggaaacaagatcaaattacaaaattctcattctctgtaagatgtaatttacaaacaagctccaaagcattctctaggacttagaattgagagaagttttaaaaataattttcaaaaatgcaacactggagcatacaacagttttctcaatagaatctttacagcaattaaaataacaaatttcacataaaagtttcttttaacatttcctcagtgcaagccagagtgataacataaggaaagattccccaaaataagccatcttgctaggaagtgtgcaattcttatctggatctttaaacatacactaacaatttccagaatcttatgttaaattccattttcaaattccaacttcatattctattttcttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggcctcatattctattttctaaagtcaggttcttatgctagatgagagcataagatcacataaaatgagataaccagggttccagatcaggcaaaagataaaacattggtaggtaggtccagacaattataagggacctttcttcttttttttttttttttttttgagacagagtcttgctctgtcgcccaggctgcagtgcggcggtgcgatctcggctcactgcaagctccgcctcccgggttcacgccattctcctgcctcagcctccccagtagctgagactggccaagggacctttctttttaactgaaatgagttcctcttttcgttggtgatcttccttctatgatcctgcccattacaacagctgggagtccaatctatgatgatgtttaatcctccccagtttggtatttctaaccgtagtagataaatgtgactctgtcttcacattcagtttgcatcaatttagattcatatttgcatacttttagaacatttactttttgttactggtgcagaggaaagacagcaaaactgatacaaaggaaatgtcctatctcttattttattatacaagaaaaaacaagatctaccagtgatgtcaaacgacatgctaccatggtataatatccagcctgaacactaataaaatgtaacaatgatgcattctggttttcatgtcaggtaaataggttgtagcaaatcatatcttccttactactgggttggtctgctctctgcctcccaaagatcctaaatttatgtcctcctgcctcccagattatgcttatgttgtttcatatctcttctcctacctcattatcagtttaggtctcatcactttcaggatggctctctctcagactctacttgaagggcccataaaagctttctctacataatttagctatatattactatataattatttggggattctccttattagatcttgaaattccttcttttatattacccaccatgaataacaaaatgctcaacatgtagcaaatactctaaatacaaataaacttactataatgcattaataaactgctgtatatatttataacagctcatgtttgttcaacataactaggatatttattatgattgcatcaattgaaccagaaggcaaatttttaccatacaggtgatttctgcatggtatacaatcaacccatatttaatcaaaccttgggcttttctgttttcaagcttgtcaaaataatttcaattgtgagacaacttttgagaacactaccaaaaaccaaatctattttgtaagctagtgtcaaacctcaaaatgacgaagattaaatgacaattttcatccaatacagtttgattcgtatttgaactcataacataaaatttatgaagcttattactttattaccattcaaagaattcttccaatgtgtagccattaaaatttatttctgaacttcctattttataaaaattcaaaccttagtaatctcaatatataattctgctattgtaaaaggtagtagtctttagatttggcataatatatacactcccttaccataatttcctgcaataaggaaaaccactcctaatatttaaaaatatgttagaaaacatacactgaagtatctcatattatcaacttaaatcaatcaagattcattctgttcattaaaaaagttataggataattatcatggttacattattaaccatcttataattgtttacttcaaagaacaaaagtaggaaacatttccataatataaattgaaatggcttttgaacaaatttaacaacaaaagaatattattcaattttctttcttttccttaaaaacaaaatggaaagagtaagccaaagacagatacagatgtgtatattttcatttattgcaacataatagatacacacagaggctgtgagaatacaatattcatttttctgcagaagaacagacattgcataacaatgagatttgctaatgaaatcaaccatcaacctgaaatacatatgtattaaaccaagacctcagtgtcattttctttttgaatcgtttgttcttactttcatttttttctcgaccttttcagtatttttgtcctttagattttagaacttatgggtgaagcaaaatcaactctatattacaatgtattgctttttattcatcacatttattttcaatgtaaattccaattgttctgcttctatcagcactattagtgtaccttcagaaaaaagaaatcaatggatgctaccagaagaaacaaaggaggtttatttctatagagaattgttggatctcaggtccaaaaaattttttatcaatatttcacataaattctatgtgaaaactttaattgcaaggcgagtgcttacttatttaataagaaataagaaaataataaatacattttaaagtcacttttgtaataatataatttcctcgacaattttgactactgataattattaaatgaaataatgtagggctaatataatcattaaaatgaaaattattctcaagtttttaaaataatacttttccctcaaaatgttttactatcctggtctgcaaatgttgattaccaattaatattttcaaaaataagtaatactgggaattttcttaaagatttatgatttagttacaatcttcaataaaagcacaagactatgaaaatatttaatgtgatgtatcttaaagaaaaaataagtattaatgtacccccagaatcaatttatatccttttgagtataggatatttaactaaagagctatctgtgctattggttatccatttacacaaattaggttttcaattcacctgtgctacagataaaattaacaggctaatctctggcatacaattgctactaattcataataataacagctttaacaacaacaacaacaaaaagcagtacttataccaactaaaacatccagagtcaaacagaagattaagtttcctgttatattttatactacgttaatgtctaacctcaaacaataccctgcaaaaataaccaaaggcagtatcaactacaattctgttagaaataagtaaacaattagacgttccttattaaatgtaaactctgaaagttgtcactgacgtctaataattgtcaaggctatttttaaaactttgaagaatgacttgaagctacaaaccacacaaccacagaacgatcaatcaatctaaacacaagagattttcctttaaaaatccaaaaatttctattaaaatgtcaaaatatacattagactgtagagaaacagacgctttaaacgagtatctgtgcaataccaaaagcctacttttactagtacaaaaaaaaaatcctaaaacatggtgatagggtttggaaagtcatctagctcattgctactccaagtatagtccacagaccagcaacatggaaattatttgttaaaaatgcagaatcttggccaggtatggtggctcacacctgtgatcccaacatttttgggaagccaaggcaggaggatcacttgaggccaggagttcaacactagcccaggcaacacaacgagaccccatctctacaaaaaaataaaataattagccagatgtggtggcatgtgcctgtagtcccagctactcaggaggctgagatgggagaatcacttgaggccaggagttctaggccagcctgggtaatagtgagacctggtctctacaaaaaatattaaaaattagccaggtgtgttggcacgtacctgtagtcttagcaactcaggacattcaggtgggaagatcacttcagcccaggagttcgaagttacagtgagctatgactgtgccactgcactctagcctgggtgacagagcaagaccctgtctctaaaaaaaaacaaaagaaacaaggctgggcgcagtggctcacgcttgtaatcccagcactttgggaggtcgaggcgggcggatcacaagatcaggagttcgagaccagcctggccaacatagtgaaaccctgtctctactaaaagtacaaaaattagccgggcatggtggcgcatgcctgtagtcccagctgctcgggaggctgaggtggaagaactggttgaacccgggaggcagaggttgcagtgaactgtgacactgcaccccagcctgggtgacagagtgagactccgtctcaaaaaaaagaaaaagaaacagaaatgcagaaactcaggccccagactagacttactcagaatattctgtacattaaagtttaggaagccctgatctagtacctaacaatttatacaccaatttcaataatttctgatataataacaacccctcaaaaaatccatattaagagacagaatactcagggaataatttatttgttgtgcccaaagtccacggcctatcttttgcttattcatctaagtctcattcatatggactactgatttaaaatttgtggtaatatgaggaataagagggcagaaataatatgtttctataaactattggaaaaaaatacatataaaaaacaagaatttacactcagcaaaattttaaattgattcagcagaggaggcctttcttcaaataaaatatgtgaagaagcccagtatgtgctcacactgagattacaggctcacacctgtaatcccaactcttgggagaccaacgtgggaggatacattgacgccaggagtttgtgaccagcctgggcaacacagcaagaccccatctctacaaaaattttaaaaaattagccaggtattaaaaaaataaataaaataaaattagccaggcatggtggtgcgcgcctgttgtcgcagctactcagcaggctaaggtgggaggatcgcttgagccgggaagtcaaggctgcagtgagctgtgatcatgtcactacactcgagcctgggcaacagagcgcaaccccatctcaaaaacaaaacaacaaacaaacccagaatagcagaaaataaagagctgctttttggggtagaggaggtacctagcagctgccaagatatttcaatagaaccaattcacatggttctgcaggggacactctgacctgagaaaaggggattacttaagagtctaaaaacaagtggaaaagttgttacactaatcacaaagttcactatttatcaaagcaagtcctcaagtttattctgtagtattttaaactaagaacactggattaaaattacataatttttttgtaagtaaaattgatattttcctaaataaatccaatcggcgaagttagaagtaactaaggttatctttaattaaattattttaattagtagtaggcctgtcatttacaaggcattatgttaaatgctagtaatatagatgaatggacaaagtactctatttatcgtcttggaagaataaaataaatacatggtagtcccagctactcaggaaactgaggcaggaggagttcttgagcccaggagttccagaccagccagagcaatatagagagaccctgtctctaaaataaagataaatacatggaacatactaccatttataccgtaagagtggtataaataaagtactctgagagcaaaattaactgaggatgtcagaaaaaaggtttacgaaaaaatgacatctgaagtaggctttggaaagcagtgtaggaatttgaataacaaaggtgggtaggtggaggaactaggaaaagaggcatcccaaggggaaggacaacataagctaaggatcaaaagctgaaaagcactggatatattctgagaatagctaaggtggcttccaagctccctaataacaggaatcatgagttgttccttttatagcagtagcacctataacacgcaagagttaatatacaggttgaatatccagaatttgaaaagctccaagatctgaaactttttgagcatcaacatgatgccacaggtgaaaaattccatacctgaccttatgtgacgtgttgcacattatttaaaatatcatatataattgccttcagtttatgtgtataaggtgtagatgaaactaataaattcagtgtttagacctgggtatctcccctccccaagatatctcattatatatatggaaatattccaaagtctgaaaaaatctgaaatcccaaaagcttctagacccaaccatttcagataaggaatactcaacctgtacctgggcagcataagagcttgttatgtatatactgtttgaatgactcaatcaatcagtaaagtaatatagtctggctagtacaaaggacatatgtaaaaaaaatagtgggagagatatttatttggctgaaaacgtactttaagaccttattggagatgaccttaaataccacactaagtgtttgattttaatgctgcaaacaatggtaaactacctgcttagaaatattgatctagcagctttaaggaggatgaattgaagcaggaagaagtttacaataaggatattgcaatagttggtctcctgagataatttaggcaaaagtgaggttttgtactaaggtgtggcagaagagtgacaaatgaggggatggataaatataaaagttattcatatatagaagtagggataatttttttttacttcctagctggttaaactagagaaagaaatgtaaaaattgtattgtagaagtaaaatttattggacttcaaagcagcctttatatgcagaaagtaggaatacaaaaattaagcaaatgccaaaaaagtagagcagaaatcttttatgcattgatcacataaactggtacaattatatagaaagaaattaggcaacatatagtaaagtcaaagcagcatgtagaccgtaatacagtaattctagatatctcacccagaaaagttcccatacatgcacataaaaagtcatgtatacgaatgtaaattgcagttctacttgtagagtaaaaccttggaaatattggaaaatgaaaaaatgaaaatatcacggtatgtttttataatgaaatactatatggtagttaaaatgaatgacatagagctacttatattaacatagatatatatctttaatatgctaacacaaacacttgagggaagtgaaggtttaaggttttgtttgcacttctgtttatcactttatttcatgccaggacaatcctttggataacaatgaaataaaccagtcatgagggagaaaaatgaatgtcttttggcagatcatgaaacaagcctctagagaaggcagaaatgaataaaaataaaaaagcatgaagttttaggtttagtaaggaggtgaaacacttcatttctcagatatgggtagggaggtagaaggaaaaaaacctaatagttttttgtttttttgcttttgagacagggtctcattctatcacccatgctggagtgcagtggaatctctgctcactagcttatatagtaagtgtgtgtttcttcctttttttttttttgaaactgcaaactatttttcagagtggttgtaccattttacattcccactggtaatgtatgagagtctgatttcttcatatctttgccagcaattcatattgtcgctatttttaattttaatttttttagacagggtcttgctgtgttgtgcaggctggtcttaaactcctgggttcaagcaagagttcaactgttctaataggtgtgtggtaatatgtcatttttcaatttctctgacggctagtgatgctgaacatcttttcatgtgttcagctgacatccgtataacctttttggcgaaatgaatatcttttgcccattttctaattggactgtttgcctttttactattgagtttttagtttttatatatcctagataagagtcctttgtcagataagcagttttcaagtatttcctcccagtatgtagtttgttttttcatcatcttaacagggcattttgcaaagcaaatgtttttaattttgataaagtccaatttacagatttctttcttctatggatcatgtttttgcatcacatggagaaactcttcaccaagttttgtcttgtaggttttcacctatgttttcttctaaaagctttatatttctacatttaaatgtatgatccaaacaggttctgagctacaggagaagaagaactgaacaatcttttcatcaggacttcaactactttgtctagttaatttcaacatttactgggtatccacttaaagtggatactacttaaagtagtaggcacttagcacagttacaaagtatcagtatcagatacacacaggagaaaaaacacaaatatatatttttatttcactattttcagtgttttgataagagttatacatgagtgcacctgacttacccaggaagagcttgagagtgtttctgtagactacatttgctctaaacttggaagccttctcacaggggaaggctatgtcaggaagggataacagcactcagtaaaggcaaaaggactatatacacacctcttgctttaaggaagtataaatcatttaacatttggagactaagtatgggagattgaggcattacttttagatgtaagcaggagacaggctgtggaagatttcatataccctgtaaatgagattaaattttattctgtagtggttggaagctaataaggagtttaagtaggtaaataacctagtttgatttgtgatgtcaattatatcatcattgagaggatgatgaacttggacacagcaagactaggggcagagacactagttagggggttactgtgacagcccaggtgagacatgatgcaaatctacattaagatttaagcatcatgaacagagaaggaaagatggatttgagaaatatttagggggaaaaaaagaaatgtagtctttgttaaaaacaggccgagaacagtagagaaggccaggtgcagtggctcatgcctataatcccagcactttgggaggccaaggcggttggatcacctgaggtcaagagtttgagaccagcctggccaacatggtgaaaccccatttctactaaaaatagaaaaattagccaggtgtggtggtgagtgcctgtaatcccagctacttagtaggctgaggcaggagaatcacttgaacctgggaggcggaggttgcagtaagccaagctcgcgccactgtactccagcctgggtgacaagcgaaactctgtctcaaaaaaaaaaaaaaaagaatagtagagaagttatgaaacagcaatcgattgtagaaaatccttttattaacctctagttaacctgtaggattgtctaatacagcacttaccaaagcatgaaaaacactagtcccataagatgttctttgaaggaagggtcaaataagttggaggttcacaaaacacattaacacattttaaaaggctcagaaaaagttgttaaataaaacaaaaccctttggatacaggaaggggaacatcacacaccagggcctgttgtgggggggtgggggtggggggagggatagcattaggagatatacctaatgtaaatgacgagttaatgggtgcagcacaccaacatggcacatgtatacatatgtaacaaacctgcacgttgtgcacatgtaccctagaacttaaagtataataagtaaaaaaataaaaatatacataaaaaaataaataaaacaaaaccttttaacattaaccctatgtcttccaaacttacttgaccatggaaccttttttcatgaaatactccatacaaccaatgctctaccaaaactactttgggtaccactggtttggcaacaatgtgggctttggttaagcttcaatcttctctttaaaaaaaaaaaaagacatatgcttaaatgttcatttatgtgaaatctctctggcttcctttgtaactctctctcattgctcaccaactctagccatcctgatttccctattattcttggaatatgcaaagcacaatctctctcagtatcgtggcatttactgttttctttggaacagttctcacccaggtatctacatggctcaactccctcacttccttaagatctctgcaaaactgtcatcttattggagaggtcttcagtagccaatctgtaacaaatactaattcatacccctggctaattcatactcatgactcttaatttgctttacctttctcctaagtgttagttgccatctaatatactacatacaacttatttatctctttcaccaatagaatgaaaagctccatgagtgcagagtcgctgttgtttagtaccttatccttagcacatgcaagtaactaggcacttaatagttgttgaagaatttagtgatcatcatataacctctgattgtatttattttatattaaagtagataataggtaaaatacctacatatcaacatattcattgataaaaacagtattttcacttatgattttgtttttcatatttttcatgtccacattcaatatgaaagatctcaccagttttatcctttaaaaaaagtgaggattttggaagctttcaactctaacttttcaaacttttctcttcatcaaaaacaaatctaaaattgctacataattatatctttagaaaatgcacagtcattttagtataacttcttaaatttctctttagcacttccttagacactggcctgcaaaggactacctataatattgaaagtagtaaccttcaccctctaaaacagagtcactttcttttgtgatgtacagtgatttctttctataacttttgcaattgttaagtgctttcataggttttaggtgtgtaatgcctctacttttaattttaaccatgacttattactcttcagtatagatcaactgtccagctgaacgtatttcacataatactctcatagtgacatatattccccttaaaacggaaagaaatgctcactgataaatgcagcaatttttcaaaatatctcagtatatctataaataatctataaaacccttaaatattttaatataaaatgcaatatttctacaagaaaggactttaaaaaatacccaaataagttaacacaagatatatactttaattggttctgcttcatataaaatatttattgaggaataacaacagagttatgcatatataactttataatccagatataaactctccattcatcaaaatttttctatatagcaatatattaatagcaaagtaaggccgagtgcagtggctcacaccttaatcctagcactttgggaggccaaggttggtggatcacttgagatcaggagtttgagaccagcctggccaacatgatgaaaccctgtctctactaaaaatacaaaaattacccaggcatggtgccgcatgcctgtaatcccagctactcaggaggctgaggcaggagaatcacttgaacccaggaggcaaaggctgcagtgagccaagaatgcgccactgcactctagcctgggcaacagagactccgtctcaaaacaaacaaacaaacaaacaaaaagcaaattaaaatgaaaattctgaattccttccagtaaaaatacctgcaattgaaaaataaataaaagtctctgaaattattattatcattatgcatctgtcatgaataattaggtgtattctgtgggtattatgttttatttaaagagagttttacctgtaactaaagatattttataacaagtcataatttaagagtcataaactagctaagtagtcttagttaagtcacactctctgacccttactttcctcatctggaaaatgagtggactggtccagggtttttagcacactgttaggctttaatattctgtgattctaaaaaaaatttttttcgatcaatttttttgattgaaaaacttctatgagatgtttttacttttgcaaaccaactgagaaatatttctgatactagaaatgcacattctcttaaaagcttatttctttaaaaagtagacaataaaatatatttatgtttctttataatgaaacacctcaatttgtactgaaatgtgatgacaactatttatctactttaggtgaataaaagctgagaacaatttattagaccatggaaaagactcctgaatactagaaggtcacagcctatatgctgagctgctagcaaaacatctatgtgctccaaagctgccatttttcttccttgacaaagactccatctgccaccgagccatttacagcctccaagtcagaatatcaatgatttccaaccattctgcaagcctgctttcaccttgacatcacctttgtaatacatctacagcagatgatacatatatccccaactacaagcatgaagcccatgctttattcacctgagaggtatttaagctgctctctaaagtaccatttttattcatgctaacttgcaaaagaattttaaagtgtatatattcaattatctatacacttacatatactttcctataattccttttgctttatgtacctgaaatcaaatatattcctaaaactttaaaacctaaaatgactttagtttgacatagttttcaatggcttagaaactaagacaacagaagtacattgtatttccatttaacaatctgccacaaaattattttttataaaatattttatttccttagaaattgaaaacactaaaacaatgaagaaatattgataacatttctagttttgtactctaatcaatgttttttaacattttaaacaagtgaaacccatttacatagtaataaaataaaaccagagaatttttcaattatattttgtagaatgctaactaccaagaactattaaaaacacttcttccatccttttaaacaaaagcagtaaaatccttggctataatatccgtacaaatgaaaataaagtcttacacttttatctgaaagtaaatgttctctaccaaataaataaaaaatgaattaaggcctattatgtgcaaaatattacggggagaacaaaaaagtttaaaacaagactcatggcctcaaactgcggaaataataaatgcactcatgaacaagcatctaaaaagacaatgcactgtacagtgataggaagtgtgttacataagaaggaattttggaattagaagttagggacttaagtttacttgcatctctgccctgaaatctctaagtacttatgttaatcatttaactccagaaaaaccactaactcacctgtagttaagtgaccattataagtgatatctaaggtctttttctgctctggcactctctgataaaaggattctgtgtcaagatgtcaaatgattacacatgctacctggccccagattttacaagtcacactcgttttaggtagacatggccagtacggagaaggaaatgagattttagttgagtctccaagaatgtgcaacattaaaatatacatggagagacagaaaaagtatctcccagaaaaaggaaataccataaacaaaggtgcgaaaaacaaaatcatgacttcagatgtgtttatgtggcattgttatccacaaaaagtaagaataggagacatgatactggagacagagaaactagaaagtaaattaatatggcaatctaagcatgacctgatagggtggtggtgggagtgaaaggaaaacaaaggatgcaaaagatattgaagatagatcacaggcacttttaagttttgattatttgaagctagagaaaacagcaatctaaagtggtatcaagagttgttatcttgttgtgggaaatggtgaaaccattaacagtaataggcctgatacataatcctttttctaaaacaatacggaaagaagaatagaatacattaaagaggattgaagaaagtcacttaattttcagaaaaagaacactggactaggaattcgacaccaataccagagtctcaccgtaaactagctgtgcaatatagatcaagtcactctgaggtttggttttccaaaatgaaagtgctaaacttatgatcattttcatcattattttcagctttatatataacacattatcttaatttccccacaaacttcaagttgtagaagcaggcaatctttcaaaatcccttcttaatcttgactgatttaacattttttacacatatgaaaggctgaaaagtacaaagtactttataaacaaaaaagaagaagaaagattttcaccaaacaagtataactaataacacaactgccacaaaactaaaagcagaatcagagatttcagaattaacccggcatttctgatcctgcttcagccactagctggtcattcattaaatatcctttatgagcaactaagagtaaaccaaaagatatacagtttccatgtttaagcatatcataactttattggtgagataaaaatgaatgtatgtgaaacaaaaatggacttttaatgtagactaagccacatactaagaaaatcattacttaacatttctaacgaaagctaaaactgaactgtaatctgaaaactgtggttaacagaataaatattgtaagttttcctttaacgagaggccgtaatcaaattaaaattctataaatatttcatactgttattttttgcacaatgattcctcataatttcaagtaaaaaccttgtatctattcctatgttatgattccaaatacatgggggacttataaagtgtgtttctgaagggatgtgtaaagcaaatagagtaaaacaattttatttactaaacagaatttacagtcatgcatcacttatccacaggtatatgttctgagaaacgtgttgttaggtgattttgttgtatgaacatcacagagtgtacttacgtgaacctagatggtaaagactactacatacctaggttatattgtatagcctgttatttctaggctacaaacctgtacagcatgatactgtatggaatactgtaggcaactgtaacacaatggtgtttctaatagaaataggcctgaaatgtgaatatgaaaagtatttgtataggtaaacatatctaaacatagaaaagaaaaagtaaaattatggtattataatcttatgggacaactgtcatatatacagtctgtccttgaccaaaacatcattatgcctcctgtgacattgtattctgaaataatttgtactccaaacataatttcttcttttttttttttttctgagacggagtctcgctctgtcgccaggctggagggcagtggcgcccacctctcaggttcaagcaattcttctgcttcagcctcccgcgtagctgggactacaggcatgcacctctgcacccagctaatttttgtatttttagtagataaggggtttcaccatgctagccaggttggtctcgaattcctgacttcaggcgatccacctgcctcggcctcccaaagtgctgggcttacaggtgtgagccaccacacctggcctccaaacataagttctaaatcaataaacaatttttatagggaagtaaatttaacaaacgtaaaaaagggaaaagttaacttctagaaacttgtcttatttcttccattaaaataagtatgccaataataaataattaaaatcatataccagagcttattactcttaatttttcagtacttactattaacatatacacaactaaagatataattaaattggcaagtgctacatatgttccagtgaggtaaatttttgctctttgggaaaaatatttctatatactcatggactttgatctccaagatgacttcttgcttatgaaaaatacacctggctgggcgcggtggctcacgcctgtgattccagcactgtgggagactgaggtgggcggatcacttgaggtcaggagttcaagaccagcctggtcaatatggtgaaaccccgtctccactaaaaatgcaaaaattagctgggcatggtggcatgtgcctgtaatcccagctactggggagtctgaggcaaaagaactgcttgaactcggcaggtggaggttgcaatgagccaagattgcgccattgcacttcagcctgggtgacagaacagtgagactctgtctcaaaaagaaaagaaaaatacacctttattttatttgaagaatattatgactcaataaactttctctattttgctttaaaagctcattatcagtatgtaaaaatgatcacagtatagtacttaaaataagacaaacaaaattaattagaaatgttctgagtgttacctataaaaatacaacttcagataataatgaaccccagctctctttaaagacattaatattctctcttcattattaacattttactaaaataaaatcaattctttttccactcctcaaagcaaaatccatgttagaaaatggtctgcagctaccaggtcacttctgcaattgtctgtctgaatctttagccagtgctaaacatatctgtgtggcaaaggtttgtgatttattgctgctgtagtgatttggtaattggtccccaagttctcatacattaatgctttatttttaaatggcacattagaaaagaataattaatagaaagtaactgatccacagtatgtgtgaaattatatacagatttgctgaacacatgagcaactaactacaaatatacattaaaaacctgtttagtccagtgaatatttattgtaaacaagtttgaggggttaagttccaacactgaacagacatatgtgaataaggtagttttgaccacaaggagctcacaatcaaatatttattgattgattgatttttatttatttactttttttaaggctagtcaagcaaagtagtgggagtggagaaaaaaacaaagaaatctgtcactggttgtgaacaattaggtgtaaacaccagggctctcagatcagccacaatcaaatactttaaatggaaaattttctaagtgttcatatttttaatgaaataatagcgtatttaaatttgtatttctaataataaataaaataagagtatttctcagtaacccagaaagaacaggctgagaaatttaaatgcataccatgtgtgttagtgagtggcaatcagatcagagtgttcaatccctgtgtcacacggagatagctaccacgatggttctgaattttttgcattttaaaatttgttgaaagaatagaagcatgaggtgaactaataggaaaatgaaagccaatgaaggaagaagatcttcgctaaattcttcagttgcgtgtaactgctcaaagtttttacatggcacatcaagatgtcttttttatttcaaaaaccaatgttaagaaaaaaagtaatgataattacttttatataataaccaaagtggatacaattatgttttctgaattacgacaaaaattacaaaaacaaaccagtttatttgttgacattgaaagaacttcaaacatcagcaaacgaaagcaatctttaatatttacatgtggtacagcaaaatttaatctatgtttaataaacaaaataaaaatatcactttaaaatgtcgatatcacgatagtgaagaggcaaaagcaacccaagagtccatccacagatgaatgagtaaataaaatatggcatacacacacacacaggagtatcattcagccttaaaacgaaaggacattctggcacatgctacaacatgcatgaaacttcaaggacatgatactaagtgaaacaatccagtaacaaaaagacaaatactgtatgatctcacatatacgaggtacttacagtagtcaaaatcatagagacaggaagtaaaatggtgggtcaccaagggccaggggaaagtggtcatgaggcattattgtttaatgtgcatagacttttagttttgaaagatgaaaagaattctggagatggatggtggtgatgaccgtacaccaatgtgattgaactgtacatccccaaaggtctgactttcagtcttcttctggataaagggataaatgaggcactgttacctgtctgtgttaagtggaggagactgaggaatctaactaattgaacagactttgtatgtttaatgaatgtttaataaacatttcccattttcatatagtttttatatgtagagcttcgcctgtacctataactataaccttcttcttccctcctgcccattctagagatacacacaactgctaattgctgagcctttcggagtttcaaatgtgtaaactgttttttctaggctttcttcactgtcatctgataattcagttattcggttctctcaatctgataaatcagttactatttatctattgctctccagcttccagaattttgttggtattcattcttctcctgtttctttgcttatgcctttttgaaaatttttttttcctatataattaatggggcttcaacagttagctgaagtaagtgtgtatgttaatctaccatctttttttaggagcctattgtcctcttcctcagtctcatgaaatcctttctatgttagaaattgtcttctgtaggaagaggctggtttcatgagtaaatactatgtgcaattaacttttttgtttgtttgtttgtttaggaggagtctcactctgttgctcaggctgcagtgcagtggcccgatcttggctcaccgcaacctctgtctcctgggttcaagggatcctcccacctcagcctctctggttgctgagactacaggtacgcaccaccatgtctggctaatttttgtatttttagtagaaacagggctttcaccatgttgcccaggctggactcgaactcctgtatgtgcaattaactttaaaggtcaattttatagaaaggcttctgatcttcacctgaaattctgctatgtctgctgtttttatcatttcttttaatactcactgtatatatgaaatatttgcacaacaccacagtcttttttgatttaatccttgcatgtggtactctgcatttatttgtaactgcattttcattttaggaatctgactagatttaactttctaagagccttcctcctgcttcttggcaaacacacttaaaaatcacatcattttctctatggtcatgttgcccattccagttgtacaggcattctcatgtaccactctggtgtgtcttacttatgaaagtgtctgcttaatattatggcaaaaaagcattgtatatctatacctagggttttgaattggggaaagatctaggcacccagttgaggaccaacagaggacattatcacatgatcagagataaatcaattcctttgtttataatcatacagcccaatactcaaaaaacatagtggcaaaatttgctatgaagcctgccttcaaaacttttaacattttatcttctcaccttatgtaaacttacaaatacaaaagaaaagggatgagggaaaaaggaaggggaagaggacaacagtaacaaaatgcaacataacgctttttcactctctacttccaagagaattcaacttttccatgtgtcttaagacagatactactttattttcctataaagttggaaaacataaactgtttttacatattttttgcagcatcagcatcactgttcaaatagtgatacctatactctgcttcaaaacgcagggggcggaaatctccatagagtgaatatttttgatgtggcctttcccacccataaggatcatatcatgctttctatagtcaaaaaacattaaacatacacctctactgtgccatctaccacagctataatgaccagtttatgtgtctgtctctccagtagaagataagctcctaatgaagaaaagaagaacagtgcattttctacttttataaatttagtaagtaactcaaaaagaacataatgcttattaaatcaaggaataaatcataaccatgaatttctcttcaagataatggaagtttcttaaatatgccagcaagggcaaataatttaggggcaacacagaagaatgcaaccaaaaatataaattcatacacagcataaagaatttataataatgctttaataccatttatgtactagtgtcctccataaaaatctccactaggagaaaagctgaatatgaaacagtctcaaattaaacatggtggtggagggattattaaaatcaaccaaccaaaaaaatcttccaggctagccatggtggctcatgcctgtaatcccagcacttggagtcaaaggctgagataagaggactgcttgagcccaggagttcaagaccagcctcagcaacatactgagaccctgtctgtatttaatttaaaaaactaaaatcaaatgaaacatcttccagtggcttctcttcacattagaaagaagcttaaactttttttttaaatgatatctgcctacctttattcccacagctcactacattccagcctcactggcactgtgatcactataacctctgattttcacaacacgacacctggctctttctggtgattcatttctcaacacaagtgttacctcatcagggagaccttccctgactgttatatgtatgttgccctcaattctacctgactacctgtatatgctatcacattttccttcctccatccctgtttggagctcttatcaataattgagaatattttacttatatatttgtttacttctccccagtagaaagtaaacttaatgacagaagaaacttcatcttattgaccacagtaaccccaatatctagacagtggaaacacacaagcagcactccataaattatttgtagaatgaataaatgagtgaatgagtgacagtatgtgaagcatacaatataatgactaaatgaataaatggctaaaaattcctacctaggaatgtgctgtcaggcagaatctttgagaccaaacaactttccatctgatagctttcttcatgtctctttccttactgaatatcaatactacaactgaggtacacaaaaataaagataattaaatgagagagattggcagtatataagtgggttgaagaatgtgtctcataagatcacctcagggcacacactagctgattctagaattcttttctttcataatcctgtttctgtcattcaatcaactagcaagtatgcactgaggatgatgttttctatttctaaatatccatactaaggtctcttgaacacaagttagttttatatcctttgagagtattgtagtaaaaacagcatggtcttcagttagtgaaatatgaatttgaatcttagttacaaccagtactagttatgtcaactaggagcagttacttaatttcactaagtctaagacaaaacgatacttggaaactatctggtatataagtaccttcattgttagttctcccttagagagcaggaactgaaaagtagaagaaatcataagaatagatcaaacctatctttattctaatgttcactgttgaaaactgtggttcacctgtttactgagaagcaacaagtcacaagcagagctaacaaaattaatgtaaatgtgactacatttgcaaagggtaaaatcacatctctcaacatagtaggcattcatctgctgaaataataataacatcaggtcacagaaacttcagcctttaaattttttacacatttcctagatttgtatttctaagaaatggggtgatacagatgttagatccaaacattcctggattatgacctttgttttactgcttaatcactgtatgaccttgagagagttatttaacttctataagcctcaattaaaatcgggttgttgataatttaaacatacttcaaacatttcccattgctctagggtaaacaaacaaaagcccttattattattattattattattattattattgttttgagatggagtctcgctccgttgcccaggctggagtgtagtggcatgatctcagctcactgcaacctctgtctcttgtgtcaagtgattctcctgcctcagactccagagtagctgggatttcaggtgcccaccaccatccctggctaattttttgtatttttagtagagacggggtttcaccatgttggccaggctggtctcaaactcctgacctcaggcgatctgcccacctcagcctcccaaagtgctgtgattacaggtgtgagccactgcggccagccaaaagtccttgttattaaacaaacagaagttctcattatggtctactatgtcctgtattttctggttgcttatctcaaactgcaatccttgctctctgtactccagtcatactggcttttagttctttccttcaaagtgctacgttcccttcctatttatctgagtagtaacctttactggagttctttttttcttcatatgcctttaagttactgtccaggttcctctcatttcagcctgaagatctcccattagggcatttcttataggcaggtttactagcaacaaattccctatctaaaatatgctcaaagagcaaaaggaaacccatagacaaaagaatgaaaggaaaccaggaaaacaatgtatgaacaaaatgagaatatcaataaagaaacagaaattttaaaaaggaaccaaatagaaattacagagctaaaagttatgatagctaaaatgaaaaattcactagagggattaacagcagatatgagtaggcagaagaaaagaaccagtaaacttgaagataggtcaactgagattattcagtctaaggaacaggaagaaaacagaatgaacaaaagtgaacagagcctatggaacctgtaagacaacattaagtggaccaatatgcattatggatatgccaaaaggagaagaaagagagaaaggagtagaaacaatgtttgaaaaaatagtggatggaaacttcccaaatttgaagaaagacatgaatctacatatccatatccacaagctaaatgaacttcaagtaggataaattcaaagagatccacacaaagacacattataatcagctattgaaagccacagagaaaatcttgaaggcagcaagagaaaggcaacttgttatgttcttatgtacaaggaatcttcaataagattaataagccaggtgtgccggtacatgcctgtagtcctagctattcaggaggctgaggtgggaggattgcttgaacccaggagttcatggctgccatgagctatgatcataccactgcaatccagcccaggcaagagagtaagatcctgtctctaaaaataaaaataaaaataaagaagtatgagtaagattaacagctgatttgtcatctgaaagcataaaggcaagaaggcagtagaaaaacaaatctgaagtgcttaaaaataaaaaaatccaaagaactattaaccaagaattctataatatatccagcaaaactatattttgaaaataaaacagaaattaagaccttcccaggaaaatgaaataaataagattaatattaaaagcacctagcatcatagtaaaaagagaagaagtgcagcataacaataaagacacaggctccatgtcaaatgcctgggtttgaatcctaaacttcactgattgccatgtaactctgggaaaattccttaacttccccatagctcagttttcccacctgtaaagtaagaataataatgatacctccccctcacaaagttgttcggaggatgaaataaattaaagctataaactcatgacagggtgcctggcacatattaatcactgaaatgttgactattacttattattatcattatcattttatagaggttctaaaaattttagttcttatttccttgaatttcccatatttctgtgaaacaaacactgactattgaggaggtatgatacaataataatctttttgtttgcagaagtatgaattggtaaaataataaaaatttattttaggtatgataatgctattaggctaaatgttctatcacctcctttagcaaatcctttattatcagagacactgagtaaaataagtgataatgaatatactttttttttctctctcaagctttgcctctgagatgcttatccttttgtggtatggacttatgctttttatataaacaaatagccccacattattatcatacctaaaatcttaacaattctttttttttttttttttttgagatggagtctcgctcttttgccaggctggagtgcagtggtgtgatcaaggctcattgcaacctctgcctcctgggttcaagggattctcctgccttagcctcctgagtagctgcaactacaggcacacgccaccacacccagctaatttttgtatttttagtagagacgaggttttgccatgttggccaggctggtcttgatcccttgacctcatgatccacctaccttggcctcccaaagtgctgggattacaggcatgcgccaccgcgcctggccaacaattctttcatatcaaacactcagtcgatgtacacatttctttgtcttatatttttaaattgcctgtttgtttgaatctggactcaaataaaatccatatattggatctggctgatatgactcaagtctcttttaatctctaaatgctctagccaatcttttctttttccttccttattatttttagctaaagaaactaggtccttttccttttagagttttccacagtctggattttcctgactctgtccccctggtgtaatttaacatgtccttctctcctttttatttcctgtaaattaggcttgatcatatttagttttttttttcctttggctggacagcctcataggggaggtacatacttttgttagcaagtacataatttctttcttatgtaaaacagtgataataatggtgtctaactcttagagttaagaggattaatttactacaggtcaaaagtttagattagtacctggcgcacagtgagcactccactaacattagctcttattgttacaatgcatatagagaatcaataggatttgataccagcttagatgtgaatttgtgaagaagctgaagataactaatatttctaccttgagcggctaagtagatgttgatatcattgactaatacagggaatatataaagaggagaaggtttctggaaaattagaagaaaatgagttcaagtttgaacaggttgaattacatgtctgtgggataaccaggtaccaatcctatatagagagctgcaaatggaggttctgcaatttaaaagagaggtctggggagctacagataaagatcaaatgttgggcggaaagggaacttaatgaaggtcacatttatcactaaagactacaagacctctttgaagaatggattggcattgggtaaggagaggtagtggcacttcgagaaaaggaaatatgtggaaaaaaacattccgacaaaatcgtcagtatatttgtcgctaaaggagtgctttgactataaaagaatgtgtgttggaaacagagggaaattaatttatgtagatagggacaaggctacatttaaatggctttgaaattcaggaataggtaattcaatttaagtaggaaataagacactgaaaaagttagcaagacagctgaattctgctgtggcaacattatacaaaaagctatcataacagaatctgaaaagtaaaatgtacttgctatattattcgagaggattttaatttatgccagttttatttccactgaagttaaaaggaatgttgtctaggcactgtaactttaggcaatagcccaaaggtggaagatgttatctttagtaccttcccatatcacttcccagtcccttctcctgcctctccacttccctgatgaaccagtgttctcaatctgctctaatataaaaaactacatttttgcaatgatgcaatgtcttgttccctgaagcactctggttacatctccttgcttagttctaccctgccaggaaatcattcattctctgtcgccactctacagatctcagctaagaaaaagacaaaaactgattatctaattaaggtagtgcatacaacactgtaagtgatcaaaatcctaggagatatttaatttcaaaaagaggaatctattaacacctatgaatttcaagttgttaaaatatatactatctctctgttttctatactatacattccagttacacactaaaaggcaaaaaatgtcactaattttccttatattacactttgcacaccagcaaagccaagtttgttgcatagatatttactgggtcactactaggaaaaagtactgagacagactctaatgaaactgcaaggatgaataaaatataatctatgcctttactagattataaggagtttacagtctaataggtaaaacaactgaacacataatcatcacgtaaggatctaaggactctgtaacgtttctgaaacttaacctatgtataaaccccttatgaagacagaaaaaaggttttgtgaaacaccctccaccgactgacttattatattgttactgaaatatagaaaaatacaactacggataaggataaactattcctcttgcttccagatcttatttcaaatacaataccaaaacaatttccaaatatgcacataaaagctatgaatagcacatttcaagttagtatcatacaatgtttttgtgaaaatgaatcattatagtcaacataaaaatggtactgactgctatttctccattatttttcagttacattttggtttgacatgcctatagtctagtgatatggtttggctgcgtccctgtccaaatctcatcttgaattgtacctcacacaattcccacgtcatgggaggaacccagtgggaggtgactgaattacgggggcgggtccttcgtgcgatgttcttgtgatagtgaatgagtcttatgatatctgatggttttaaaaacgggagtttccttgcacaagctttctctctctgcctgccaccatccatgtgagacgtgactccttcaccatgattctgaggtctccccagccacgtggaactgtaagtccaataaacctctttcttttgtaaattgcccagtctcgggtaatcagcagcgtgaaaatggactaatacatctagtatgccctaaatggtttaatatcatttgtttctactcaaatgactgcaaaacttttagttcactctgatgtcatcaggctttcacttaatacaagtgaaccatttacaatattaaatctatttttgttcttttctcattagactaacataattaaacataatcatagccctgaaaatacatggtagtaactggttgtaaggtaggcatggcataccacatgatctaagaatatgctcatactgatttattttatattaacattgaaattttagccctctttctccctgtggagaatatatttgcacactcaggtccatgtacccctgtgttgaagtaaattgccataacagaaataacaaatctgaaaggcagaaatgatagggagattaattccaaatgaaaaggatccaaaggttttatggaggaggtaacatttgaaatgaactgtgacatttgagtttagtgccaagtgtctacgttttctgaaatttcctttccataaagatgacactgaaaatataaagctactagagtttagaaaaaaagacacacaggaaatattcagtggtaaggggagtgaggagacaaaaatcgtaaattttatgaacaaaagttgaggggtttctcttgaggagaaagaaaatcagagaataaaattgcaagcatgagatgtgctatttgcaaaataaacagcatactttgcatgttgtaaagtttacacatactatcttacattctgatgcaaatgtagctatggatgtaatgttttaaaaatgcatttaaaaatgcattcacataaggacagcttcaggaatatttgtattagttaaacttttttaacattcatgactcgcaaacttttgatgctatacaacaaaaaaaattttccatttttgtcaaaattctttctcctccatggttttttctgtgtatatttatataaaaagaacaaagaggtcaaatatcataaacccataactcagtgtacaacacccattttctcatctctagtttctgcagactacagttatattttatccactccctgactagcatttcttatatctcacagcagaagtgtgcattggtgttctacaaagtgtgagtggaagaaaacaatttactagccatattaaatttcaagtcaccttaattcaggaaatatttacctagtctatatgctagacactgctgattacaataagaaaacatcaaaccacagcagaaaactggtttttattttatattctctgatgtttccataattattcctagatctgtaaaagtttctttttttaagacagatttattaaacagtagctcatttagaattttctgataaatcagaatctatctttaaatcaagggattgtgtaacattacacattttgacttgttcaaaagaagctaaacttatatctgtgcagcatggtgttatttatatatgcagccactcatacagagaacatcatgcatgcttttagctccattaattgttaaatgttaaaacagtacaacttctgagaaaatgcagtagaggtaaagagagggtttctttcatccaaatatacatttaggaatagcaatgggaaatagatttacatgaagtaactgaaatggctgctacatactaattttgaagatactgttcaaaatattcagactctagaaaacaaaatgtttaggatgtattttataacgttactgtactacattttaaaattttaacacctttagatttgtcacttgctataaaatatggaaattcttaaaaagattttcacttccagttttatcactgttattatattttactaaagatattttaaaattgactataactctacttttggtattagaaaagtgaaaaataaaggtcagatagtacatagtaaacttgttctggaaatgactattttttgcacttttcagataatgacttaactatcacttacaacacactaggaaagatatttgacctttccaagtctcagtttgggcatctgtagaatgtaatgatatatcttttaaaattgttaaagtttcaaataagtacctagcatcttaaaaaatcagtggataaataaatattagctttgttcttcattcctcaacacatgtatcaaaatatattatcaaaattaaaaatatttaatgatagtcaagtacagtggctcacacctgtaacttccatgctttgggaggcctaggtggaaggattgcttgaggccaggagtttgaggttccagtgagctatgattgtgccactgtagtccagcctgggtgactgagcaagaccctgtttctaaaaataaaaacataaccaaagaaaaaccccactaaaatttaatggaaaagcaataaataatattaaatttacattaaaataactcatcactaggtatctagcacttaccaaagtttttagtttataaattcctataagagctgaacattaggctcatttacttcctcaaatgttatatttcaacaacgttaaactaaggccgggcgcggtggctcacgcctgtaatcccagcacttatgggaggccgaggcaggcagattagttgaggtcaagagttcgagaccagcctaagcaacatggcgaaacctcatctctactaaaaatagaaaaattagccaggcatggtggcatgtgcctgaaaccccagctactcaggaggctgaggcaggagaactgcttgaacctgggaggcggaggctgcagtgagccgagattgcaccactgcactccagcctgggcaacagaacgagactctgtctcaaaaacaaacaaacaaacaaacaactaaaactaaaacatttacatgtctctgaacatatgttctttcaagtctatatgcctatttcctctttctagactctcttctacattatacttcaaagtctagaccacgtgtctcactcctctgcaaacgtttcttgatcccctgtgctagacagaatgaatcatttccctttccattcttctcctaaaacttccagagctgtctcatcttttggcttccccgggctacactggatgaagagggattgtgttgaaccacacataaaatacagtaacacgaacgatagctgatgagctaaaaaacaaaaatcacaaaaaaaatctcataatgttttgataaagtttccaaatttgtgttaggatgcactgatagctgtcctgggctgcatgtggcccacaggccacaggttggacaagcttgacttaaaccatggagacagtagagttcaaataaaacaagtgagatgtttaaaaaaaaaaaaaaaagacattttcacactggcataaacttttttctttctttttttttttttttttgatacagagtcttgctgtgtagcccaggctggagtgcagtggtgcaatctcagctcactgcaacctccgcctcccgagttcaagcaattctcctgcctcagcctcctgagtagctggaactacaggcatgtgccaccacgcctggcgaatttttgtatttttagtagagatggggttttgccatgtcggccaagctggtctcaaaactccagacaagtgatctgcccacctctgcctgatccacccacctcagcctcccaaagtcctgggattaaaaaaggcgtgagccaccgcatccggccacaatggcataaacattcttcatcaagctagcttggtgtatcaggattagttttggccaggagtgacagaaagcccaaaagtgaatggctcatacaatacagaattttatctctgtcatgtcaaagaaatccagggataggcaggccagtagggacagtgtaacatcatgttagtaaggattttctttcttactgctgctttacccattctcagtatagggtttccactcacagtccaattatgctcacaattcagccagcaaggaggaagggggcgaaaaagaggatgtgcacccattcctttaaggatacatcctgaaagttgcacacactacttctgcctatatatctcttgccaaaatttagccagattactatacctagctgcaagggagactggggaaatgatgtttttattctaggtagtgatataccggaaaaaaaattagaagagggggaaaaccagtattagggacaactatcaatcatgccatacttggttatatcttctctgtggtaggtacctgacattttaaatttactagctaacaccagtatttctgacagtatgtacactataaagttatacagcaattccttctacatctcaattattaagtattactattgggagaggtgtatctctacaaaatttaagtaatattcataataaaattaccaaagagaaaaatagaaaaaaaaatttttttgaggcaaggtcttcctctgtagcctaggctggagtacaatggtacaatcttggcttactgcagccttgaactcctggactcaagcaatccttccacctcagcttcccgagtagctgggactacaggcttgagccaccatgcctagctgattttgtttattattttgtagagacaaagtctcactatattgcccaggttggtctttaactccagggctcaagcaatcccccctgttgggctcccaaagtgctggtattacaggagtgagagccactgtgcccaggcaagaaattttaataaaaacagaaaaagccactttatttaaaaggttgccggccgggcacggtggctcacgcctataatcccagcactttgggaggccgaggtgggcggatcacgaagtcaggagatcaaaaccatcctggctaacatggtgaaaccccgtctctactaaaaatacaaaaaattagctgggcgtggtggcggaaacctgtagtcccacctactcaggaggctgaggcaggagaatggtgtgaacccgggaggtgaacctggcagtgggccaagactacaccactgcactccagcctgggtgacagtgagactcagactcaaaaaaaaaaaaaaaaaaaaaaaagttgccttaggacagattattaaatatacagtaaaatattaaataagaatatctgaagataaaatatagccactataataatgaaattacatataaacaagactgcatgtaaatgcaactgcaaaaatacgctcagagaagacagaggattaagggagatttaagaaaataacctctgaattattttattatactttctataaatgctatttagacacctttaatcaagtaagaactgatcacaaaacagaacagtaaaaattctaacaggataaagcaaagtcaggttagtccaagttctcaaatcatgtaattttagacaagtaactttacagatattgatgagtatgatgagggtaagaaaagtgtagtatgtgccatcttttgtgctaagtgctttatgagcaatgtttatttaatattccagacataataatattatccctactctagaaaagaaaaaattgggtcttagactaagaaactgactcatgatcacatcagctacagaagtagcagaacacaaactaaaacaaaggtttttctaaccccaagtccatgtccttaactattatgtgcactactttcccacaaactctctagaccttggttttctcgcccattacctaaggggaatgcagagtactctaaactattctatagttcattttggttttttaagatgttgccattctagttctctgactcccttttcctcaaataaaagaacattatattaataggtccaattggcctccttgctgaaacttgctgaaagtcaataaagttatcactaatatacataatgtagaaatctatttattaaaacagacaaaatggccacaatttgtaagtaaggtaaatttgaatgtttaggatatatcactgaactttatagtagatttcacgcccattggtgttatctgtaaaggagtaagccataaaattctatcacgaagagggaggaaagctaataaaaattgaatttaaatttcataatccttttaaattcaaataatgcatcgttttataggtgaagatactgaggcacaaagaggctgacttgctagaagtcacatcgctagtacacagtgacgttagtacttgaactctataggttctaaaatctaagctcttttctatccaccctgcttcctgtggttaaattatattaatgtattaatatccttatttcaattttaatataagaacactaaagatactaattgatttagcactttctggtttattatgattgccaacaaacatttgctgagtatcgtaagatgtgtattaaaataagtaccctaaatacaattatgttatcagtaaccctggagtaataaaaattaagcattaccaaactattaggaacagagaacaaggatgattagggaaaacctcagggagatgattatatgtggatatggtattagagagacagtttgatttcaccagaagaaatttttttaagtgtgaaaagaaaaagaatattctaggtaaagggaatagcatgaatgtaagtgtggagccaaaatgtgtatccaaggtagggaatgtagtccacattaggtagagtgtacagttcttattcttgagtaatagaaaatatgctgaagacagcctgggcacagttgttcactcctataatccctgcactttgagaggccaaggcgggtagatcacttgaggtcaggagttcgaggccagcctggccaacatgataaaaccctgtctctactaaaaatacaaaaattagctgggcctggtggcacctgcttgtaatcccagctacttggaaggctgaggcaggagaatcacctgaacccaggaggcagaggctgcagtgagccaagattgcaccactgcactccagcctgggcaagagtgagactctgtctcaaaaaaaaaaaaaaaaaaaaaaaagaaaagaaagaaagaaaagaaaatatgctgaagacaaactgaggaaggatcttaaataccaagttagaaggtctggatttgatcacataggaaatgagaagccaccacacattttcaagtagagaaataaaaggaaccgagcaatgctttaatcagatcaaactgggagttgtgtacaagtttcagtggaattgataatggccaggaagaagggagatcagttaaaaggttttgacatttatatggattgtgacatcaaagaaaaaaacagcaattctcctgacttctgaaaattttgattaaaacatatataaagtatatattacataatatataaatagctactacacttcagctctgaaacaacccataatataatctccctctctaaccataacattttacttttagttcttactatgtcatctcattataccagtttatggatctatgactagtctcctgatctctctacttcctttggataaatcagccctttcctggcctcattttattccagccacacggtaaacatatatttgaactactctctcactagcactctgaacctgaatcaatgttgaaatctaccctcttttcttaactcaaagggccagcaaaagcctcacaacagtgtcataacaaacttaaggtttctaatatcagtcacttatgaacctctcaaatgaacacttcttactctttaactgatatttaacatctaataatattaaatatcacctctcttcctgaaattcttggatttagatcagttgcaattaattactctcttaatgttaccctaaaaataaactgtgggaaaaaaaatttaaataaaaataagctgtgggagtcagcatttttaaattttaaaaaaggtttcatttaatgctaatgttaacttccttgattgtaaagcactagatgctaaacagaaggtttctatagaaatatgtcaatattttattataaaatattcagttagggcaataaagttctaattaagaaaaaataaacaaggaaagagctacaaatcaaagaaagctaaaatgctgcctcaggaaaatgaataaaatatgctataagcattagtagacaaaattatgatgataaagcctttaaaaataaataaaatttctctctagtctctgcaaaatgttaaacttaacaaatgaaccagttttcaaaaaaaaaagattgaacataaataaaaacattattgatatgtgaatttatacttctaataattaatgcttctggatttaatgagttaaattaaaacagttgaagaagcaggatcatggagtaaataatttggtagaaatttatttatctgttatttaagagaatttttcaaaaatgatataaagttcatgattgtaattcagattttatcacttagaattttctaatgtggataaaggccctggaaaagtttttctttaggtaatatatgtccttacacacaacagaaattaacacttaaaataaaattaaaaagtatcagttacttaagagaaccatccttttatcaaaaaactctccatatctggaagactctataaatcctataaatatcaataaaaaatttaagcaagatgcctaaaaactctaccaaggctatatatatgtggtatgtggtgtatgtggggggtgtgtgtgtgtgtgtgtgtattttttttttttttttttttagagatggagtctctctattgcccaggttggagggcagtggcacaatctcagctcactgcaacctccacctcccgggttcaagtgattctcctgcttcagcctcccgagtagctgggattacaggtgtgtgccaccatgcccagctatttttgtatttttagtagagtcggggttttaccatgttggccaggctagtctcgaactcctgacctcagctgatccacccacctcggcctcccaaagtgctgggattacaggcgtgagccaccgcgcccagcctaccaaggctacattttcataatctttccttaataattcattacaatctcaagtaatttacttttatatatatttcctaatgtggaatcaccttaacctttctgtcattttctggtaaaaataaaaactcaaaaaagatgacgttcagaatttaagtcacactgaaataatttagtatatttaggcctgtaatttcagttgtaaattaaaagtaattttcattttaaatgttttttaaatcctttaaagtaatattttaaaagtatttaaataactagctagaagtataagatatgattcatttaaaatgttaacattcaactggctagcaaaagaaataataatttcaaattatatatgttttctaagtcaattctcattctcagagaaaaccaaacttccttaaaagcttaactatcattttggtcttactgtgatcaatgtggtcaatcttgtgacatcactgttgggaaacctgcaataggaaaacaagaattagcaatcagctgaagcatacttaagaaatttcagaaactaaaaagtttgtttaaaatttgtgtctttcttcatgctgtaagtcatattgaaattaacctacggtatcagggtccatataatcagtatgacaaaaataagcataaaaggactggagtttatttatagatcattatttattatagtatggcagatcatgtttttgtttataatcaccaacaccctagggtgaacataacatattaaaaaacaagctgtaggacatttgggttacaagttttatttgtcttcaaattacgtactcagaagagaaaaacaatgtcttaaatacgtcacaaactgaagacaattaggtattatttataaatacttttctgtctatgattatcagtacagattagaaccaaaatgtcatctacttaatactggagacattaccacatgctaatatttatgaatagcgacaaaattatcaaaagattgaaaatatcactgggaagaatttagaacaggaaaaaactatttcctaaactgtaaatggcttcaagtttatccctgtgaaatcttaatttttggaattttttgttgttttttcgagacagagtctcaatctcacccaggctggagtgcagtggcgcgatcgtggctcactgcaacctctgcctcttgggttcaagcgatttttgtgcctcagcctcctgtgcagatgggactacaagtgtgcaccaccacacccagctaactttttgtattttttgtagagacagtgtttcgctatgttggccagcctgttctcaaactcctggcctcaagtgatccacctactttgacctcccaaagtgctgggattacaggcatgagccaccggacctagcctggaaatttctttattaacaaggtctaatttgagatgagcccttaaatgtttagtatcaaaaagtaacacatggttatggcattttaaggttcataatggactttcatgtattattttatcaggtcctcataacgaatccttcaaaggggcaggaaagagatattccttattatagactccaggaaaacagaatttagaaatgatacatgacttgtctaagcacaaagaactgaatttttcctggtttctcttttacctcagacctttcacctagtctgtcctaccaactactcttcgtcactctatccttaattttaccttactacttcatgattactggctctcctatgttaccattatagcctccctacttctattctttttttttttttttccctgcctcagcctcctgagtagctggggactacaggtgtgtgtcactacacctggctaattaattttttttttttttttttgagatacggggtctcaccatgttgcccaggctggtctcaaactcccggtctcaagtacctacctctgttcttaaagcaagttaatcagatcacatcattcccttactcaaaattgtacaatggctttagcagctcttagaataaaacccacaatacttattatcatgacctcttaggccctctgttacctggtgccctgactgcatttcctgcttctaccatgttccagtcacaatcacccttttgataatccccaaacatatcaaatttgttccacttcagggccttgacacttgctcttccctctgcctggagcaattgttctccatatcttcataggactggttttctcacttcaatcgggtctcataacaaacgccacctccttagagaggccttcctttaccaccagaggctgctgttagctttaactccatgaaggaagatcactggagcacaagtttagtacctggaacccaatagctaattagctactgaatgaatgagtgaacaagtatttatcaagttcctactgcatccagcattatgtcaagagctacaaaggatccaaaagaaagtttaaataaaaactcttcaagaattactatctatttaaagaaaatatgccataacaacttggtatacgtttttaagtcactgcaagaagcatttgggaagcttaaaaaaaaaagcaaggcagggggtgatgggaaagcgcgggtagtgaattaaaggtgtatgataatgagggtctggatagtgaagaagaggaaatgcagagggaatgggaaacccaaatcttaaatggtgaaaccagaaggcttcatgctaaactaagtattaggaacaaggatagcaaaaaagtgaaagattacttcaaagattctcactcacataatgaaagaaatctgaagtggcagggtggggtgacttttatttagaacaataggacaggccagtgtcaccataggccattcaaatgaagacgcttcccaccagcaggtagaaatttatttatttatttatttattttttgagatggaattttgctcttgttgcccaggctggagtgcaatggcgcgatctcagctcaccgcaacctccacctcccaggttcaagcaattctcccgcctcagccttccgagtagctgggattacaggcatgcgccaccatgcctggctaattttttttgtatttttagtagagacggggtttctccctgttggtcaggctggtcttgaactcctgacctcaggtgatccgcctacctcggcctcccaaagtgctgagattacaggcgtgagccactgtgcccggctccagcaggtagaaatttagaagagttcaagatttgaaaatcagttatataaaagtacagttcaagccaagactgtgggcaagttcaccaagggaatatgaagaaaaaaacagaacagccagcataatttggcagagacctataagtagggcccatgggaaataagagaagtggaattgcagggttttttgttttgtttaagttcaagaagtagagacatagaaaatacaatgaataaaggcacatgaagaaagatttccaaagaggaaaacatgttgaacagttttagaggggtaaaagtgttaagatgggtaaaagaagataagacaggaaacattctctctaaactaaccttctctaccccatcataccaaattagatcagaaggtagctacataggccaggcgcgggtggttcatgcctgtaatcccagcactttgggaggctgaggcaagcagattgcttgagcccatgagttcaaaaccagcctgggcaacatggtgaaaccctatctctacaaaaaatagaaaaattggcaagacatggtggcacacgcctgtagtcccgccaagctactcatgaggctgaggtaggaggatcacctgagcccaaggaggtcaaggctgcagtgagctctgatcgtactactgcactctatcttgggtgaaggagtaaccctgttaaaaaaaaaaaagaaggtggccacggagataaaacacattactctctctgtatccaaaaaactgctttcaaggacctacctgcctaacattaagctctcaactttaatcaatgcaaaaatagtcttttgatggtaacagagtcaatacaagaagtcttgtgaaggaaaaaactacttctataaaaccctgtgatacaaaacaggtattaaaactattgtaaatagtcacattctaactatgcatatctgaataaaagataaattccattttacttttgattttttggaaaaattataagttaaggatagatctacagttaaaaatatacagtttacttaaagcactaaagctcataggataaaaaaactagtaaaggcattccttcctcatggtagcaatttttatacatgacttaataggtacttgcaattgcatgaggaaaaaaatatgtgaaattaaaatgacactagaggataaagccagactaatcttaaagctgctcataaaaatcctaagtggcttttacaagcaaaaggtaattctttcaaatcatttcaaagctaagaaatgtattcaaattacacatataaaaagtaatgttacattttatgaaaacataattcaactaatgtattggttatatgctatttctctgcaagtcactgttttagtaaatatgcacagacaaaaatctcaataatattaacccccagaaaacatctacaaatgttacctaactaccaatgtgggaaaagaattttaagtcatgatatgcaatcctatgagtattttttcagcaatcagcacgtactatctttatttttcctcatgctctgccccaaaacaaagtctttctttatgtactcaattttaacatactcatgtcttaacctttccttgactatactacatacctacaaactaaagatatttatccatacctacttcaataaaaagagtcaatgaaataaatgaatagaatacctatctgctttttctcactttgctcaatcttaacacagaagtaatgctgattaatcctgaaatttgtctgtaatcatcacaaaatatttaatcattcatttatatatcagtttgattttgtgtgtgctctatgctcttttcaaggtatggttatacaataaaaaaattattttcaaaatttacatgtgaaaaataatctcacaaatcatgtgctatttgtagactgtatcagtgttgttatcttggattatggaccatggacatggagaagttaaggactgtcattctctttttaaagtgtcaactgtacatattttggcatttatttttaaggtttataaagcaacttttttttttttttcgagacagagtcttgctctgtcacccaggctagagtgcagtggtgcgatctctgcctcagcctcctgagtagctaggactacaggcgcccaccaccacgcccagctaatttttgtacttttagtagagacgggatttcaccatcttggccaaagctggtctcgaactcctgacctcatgatccacccgccttggcctcccaaagtgctgagattacaggcatgagccaccgcacccggctaaaaccctaacttgctaatcatttcaaatactgacttcttaaatttgaagattattattcagtatggaaaaaaaatcacagacttaggatataagcaatacttttttggcaggaggggaggatacttgaaaataatagaaaactatatactgggaaactggtgacaatgtgatctatccagtgttgtgcaacagaactttctacaatgatgggaatgttcagtgtctatgctgtccaatatatacctgctatgatttggatatggtttgtttgtacccaccaaatctcatgttgaaattttatccccagtgtgatattgcaggaaagtgggacataaggtagggtgtttgggtcatgggggtggatccctcatgaatggcctggtgctgttctggtagtaatgagtgagttcttgctcaaagacttgattggttctctagggaatggattagttcctgtgagaatgagttgttataaagccaagacacctttgggtttggtccctctcacccatgccagctttccctttgaccttctccaccatattttgatgcagccctcaccagaagctgagctgatgacagcaccatgcctcttgtacagcctgcagaactgttagcttaataaacctcttttctttataaactacacagctttaagtattcctttagagcaacacaaaatagactaagacagtagcctataaccaaatgtggttactgagcacttgtaatatggctggtgttactaaggaaccaacttgtaaatattatttagttttaattactcaaatgtaaatagccacatgtggcttatggctaccatatcagatgctactactatgtatttcagaaaccatagctggactgaactgtaaatggtgttcctaaatatttgaaaaattattttctccattttttataactggaaaaagaaaacctcaattctatttggtaggatatgtacatttcaataaaactgctccaaattgggaggagaggaattcttatatcttcaaatgtctttcaagtttatgtttggggaaacaggtttattttaccatagaatctttaacgtataatagagcttaggaaacgaatcttggattttggagaactgagttttaaacctcttcagattgcatcattatggcttggtatttaaaagctgcaatttgctttactttggtcagctgggcagaattgctttactttgttttctcatgtactattatgactaaaactaaatttacatttccataaattactaagaggtatcaataattacaccatcctttctggaaaaattggcattctatcaaaatgcattacattcttcatttgcatcacttgtctttattgttctgtgtgactgaaacttctctaaaaaaaggtataattcccataggttgaatcacaaaattttcagacagctaacaaaagccttattacatgaagtttagcgagacctgagatgacaacttcattgttttgcttgtgataaaaaaccatggaaacaaagcataactggctattagacttggtaaatttaaaaaacacacacacacataagctgcctgtttttccacactttaccactctattctttcaacactgcttagcacttcgcaacatctttactcattccctcttaagtttccattttagagccataaatgggcttccagtagaggaaggaggtagtagcactgccaactgctattgaaacattcttgaggttaatgtatatacacaatatccaaaagtgaaccaatcacttgggtgaagtaatacaatgaagtttcatttgagaaaaattatgtgttgttttagttatatatacttttatttatctaactacaagtttttagggaattcaattcaaattgtagcaacccacagtgagctttgggttaaacctttaggaattaagttaaagcacattgcctgattatagaaatttttagttttttataccaaaattagagtccattttggtcctgtccacaaatgccaaattgacagataatttgaccctcgcaagattgctttttttaaaaaaatcactcaaataagccagcaatcaagacaaacataaggtaacagtttcataaagttttcaagcaccatagctaaagaacagacatgatgctattccaacccacaccttcaaaaatcaatttcagactatggctgtgaagactggaaaaataatcatgcaatctaataatacagcggtcaaagaaatatttagttaggtcaaataactaaagttatcattactaataaatacaaagtttcagaaaatttgtattttactgtttttattcaaagaacattgctatgaatatttagagaaattaaatgattactgctcttggtttttcctagaacatagaataatttcatcacaaacaaaaaatttggtctaatgttttcaacagggactacataatcctggtccttactcagaattttggcatatattcattatgtaccttaggcaatctatcagtatttcttcagtttgcaataccataattatcgacttcacaagggatattgtgaagtttagttaattatgtttataacattttttgagggtcacagatgaaagaggagtgtaaggcatacatacaattaatttatagtacttggtgaaaaaatgccacttaaaaatatttaacagcaacaacatggatgaaccttaaagacattatatgttaagtaaaataagccagtcacaaaaggacaaatacaatatgattctacacatatgtggtacccagaatagtcaaattcatagagacagaaagtaaaatgataattgccagggactaggggaaggaggagtggaagttcttatttaatgggtacagagtttcggatttggaagatgaaaaaaagtaatggttgtacaacaatatgaatgaatatacttaatgccactgaatacactttaaaatggctaaaatggtaaatttaatgttatatatattttaccacaataaaatcacaagtgtgaaaatcagaatatgaatcacaagccaattttaacattctctgattcactcattaagacatgaatcgaataattcttttgttcattcagtaaatatttatcaaatgatttctatgtggcaggtactgtgttagacctgggagtatagcactgaacaagacaaagtctccgcttcatagaatttacattttagcagtagagacctacaaaatcatttttgcaaactatccttcttatagtgataagtactacactgaagggtaaagagatgaaatgacagcaaggaggtatctctgagaagataattaccctgagaatgaagtaaaaaggaacattccagatagaacagaagtgccaaggccctgagttgagaaggcctggtgttttcaaaaaatgacaagaatgcccagggctagtgcagagtaagatagggggtaggagagcaaggcagagaccacagagggcctggaaagcaacagtaaatactctagatgttattctacatgtgctgaaagccatatgggatgttatgactaagtgaatgatgtgatttgatttaaaaaaacaacaacactctagccactgtatatggaatgatcttggggatatgggagagaaaggagaatcaaaacacagtgaccagttgagcaactgtagtaactcaggtagaaataagaagactatcacggtagccatattggtggtgaaaaaagtgattatttttgatatttgattgctgatgactaaacaagaaaaaaaacagaataattaaggatgattccaaggttttggtcagatcaactgggtaaatgacattgccaaattttgagataaagaacaatgggataggaataggattgctggtggtggtagtggtaatagtagtaaggaaccaagagtgtgatcttgacaaagttaagtactcaagtaaagagtttcaggaaagataacatgacaaactgtgacaaatgctgccgggaaaacaacatgaggactgagaaatgaccactggatttagcaagataaattactttattttttgaggcagagtctcactctgtcacccaggctggagtgaagtggtacgatcttggctcactgcaaccttcacctcatgggttcaagtgattctcccacctcagcctcccaagtagctgggattagaagtgtgcgccaccacaatcagctaatttttgtaattttagtagagacagggtttcaccatgttggccaggctggtctcgaactcctgacctcagatgatccgcctgccttggcctcccaaagtgctgggattacaggcgtgagccaccatgccggcctcaagacaaatttcactggtgtccgtgacaagaatgttgtcagtgaagtggtaaggacaaaagaatgaatacagtaaaaagaagagaaagtgagatgaggatatgaaagcagcatatgtggacaactctgacggagtattgctctgaagggtggtaaagaaatggtactatacctagagggggagtggagtcttcaaagttatttttgtattaaaatgggagacagtataacacacatgctgatgacatgatctagagagagaaaaaatgatggcaaaaattgcagaagcaaaatcagtgattactaagcatctaataaatgcttaaggccaggcgtggtggctcacacctgtaatcccagcactttgggtggccaaggcggggggatcacgaggtcaggagttcaagaccagcctgactaatatggtgaaaccctgtctttacaaaaaatacaaaaattagccaggtgttgttgcgcgcccctgtagtaccagctacttcggaggctgaggcaagagaatcgcttgaatccgggagggcgagtttgcagcaagctgagattgtgccactgcattccagcctgggcaacagagtgagactcccatctcaaaaaaaaaaaaaaaggaaaaaaaaaaaagaagaagaaagaaagcttgtatctgtccttgctgctggaaatacaaaggtaataaatataagacatgaaactaatggaaggattatatggaaactatactgaaaatcatgaagggaaatacaacaaatagacaattagaaaatcatttagaaacaatactatttggtaataggctgccatgttaaaaatattacataaagcaatgttgacttttttgtttttcagaaggagtttcgctcttgttgcccaggctggagtgcaatggctcaatctgggctcacagcaacctccgcctcccaggttcaagcgattctcctgcctcagcctcccgagtagttgagattacaggcatgcaccaccacgtctggctaattttgtatttttagtagagatggggtttctccatgttggtcaggctggtttcgaactcctgacctcaggttatccacccgcctcagcctcccaaagtgctgggattacaggtgtgacccaccgcgcctggcaatgttgacatatcttatgatgtgacagcaatgtccttctaagctatatacatgcagttgcatagtgtaaaaacgtcatgtacagcctttgatttgattaatcacagttagatttagactgaatcaaccttagacaaaaagcaaagccagcaatttaagaaaacatctccactgcgcttccccttctccctttgcagtattgacccatttctgtttttgaattttcagtatccctgaattctataattcaccaccttacaacaggaggccattcacatatcaatcatttacataaattttcatcatctccagagttcccttccctttgcttatttaactatttgccatttgttctcttgcctccttaaaaaagttaagaattttaaagttataaagactactaattacgtatttgtgtaaattaatctagataagttactcaaacacacatttgcatttttaacttttcccgctctaattataagatccttttaaaccttttgtaattttatatcctttactgttctaaaataagatgtgagaggttatatactaaggtacataatatacaggttaaatgcaaactaaggaaacggagaaagaaaaataagatgaggttaaagataagggtggaattaaaaatgcattcaggggccgggcgtggtggctcacacctataatcccagcactttgggaagctgaggcgagtgatcacctgaggtcaggagtttcagaccatcctggccaacatgatgagaccttgtttctactaaaaatacaaaaattagccaggcatggtggtgtgcacccgtagtcccagctactcaggaggctgacgcaggagaatcgcttgaacccgggaagcagaggttgtagtgagccgagatcacaccactgcactccagcctgggcaacaggctcaaagaaaaaaagaaaaaaattcattcaacaagaccctgtaacctttgttactggggggaacctataaatacatggcttttagtttcctgttcatcagtgcagagaagaaatggctgtcatatacagcttttatttgtttatatcacttacagtattcataaggtaaaaataaatcattttcttgaaagaagcacagttttttttactgagacctaaggtaaatcattttactgaattgtcaaagatactgcagcaataaattcaatgtgttttgtaggactacttctttaacatctttcagagttcgtcaatggcatattgcttgggcattttagctaaaataagagggtttgagaatgttgcacattattttaattccaggatgagtttgcaatatccagagtagcagtattccacatgtttcaggtattcctccctaaaatattacaatttaaaaatcaggctgggtgtggtggctcacgcctgtaatcatagcacttcaggaggctgcagcgggcagctcacgaggtcaagagatcgagaccatcctgaccaacatggtgaaaccccatctctactaaaaatacaaaaattagctgggcatggtggcacgcatctgtagtcccagctactcgggaggctgaggcaggagaatcgcttgaacctgggaggcggaggttgccgtgagccaagattgtgccactgcactccagcctggggaaagagtgagattccgtctcaaaaaactaaaaataaataaacataaaaatcacaataaatttttttgagataaaactcaccattttaatctctggaaagtgcacaattcagtggtttcagtacattcacaatgttgtggaaccataaccactatctaattccggaacattttatcattcccaaaagaaacaacatatcaattaagcagtcactctccattccttggtctgtctctggtgaattctcttcctcctcacccatcagatgtattgcctagctaatgaacagctgatgtccatagaaaatcatattgttaacattcaacaaaaacttgaaattgtcaaataatcagaaaaaggtagatattaaagcagcatgcagcctttcaacaaaaactatgaaaatcaatagattatagcttgaaaaagaaaaagcatgtaattttttcatcatgactggattaaggcatgcaacaaaaaaattatcagatgaatcaactgctgaaaatgattaaatttgtacttatatgtaatttaactataaattatttaaatgagttcttaagttctcattcatgagaaaggagttcatgcagactgaaaagttaaaaaaaaaaaagctcttttattttggaactttaaaagtaatactagttttattctctttcaacagtgttagctaagatggttgcctggattgacagtgcctgaattactctggactgaacgggcaatatgtttctttaaagttatgggaatagaagatactgatacatgctcaaactaattaatcagattcaattagtagctaaagtgaaaataacacttctgagtttcctaattgtgattcttaagagctgaattttcaacaataatactgggagaagaggacaaggtcatgaaaagttgtcaaacttatatcacctgaatatctaaatttgattaggcataaattgtaattcactactatcttagtacatgagttttattatactatttacaagttttccctcatattagggttttcgtgacactagattacttgaaatgatcttttttttctacttattgatgcactggcagcatttactaaataacagttaatagatgtgatccattccataacaaattatgccttgacttacaatttcaacatatatctctattataaatgaaacataagcattacatatttacactactcagcgatgttctcaaaacaaccaaaaaagatttaaatgaaaaatagattattgttctcaaactgctagtgaatgaaacaagcataaaagatagaattaatcaaagagaatggctacccacagtctctgaaaaaattatgacatgagctattcaagatgaaacaatgattgtttggggagcaattcaaagaatatcaacttttgcaacacgtgcagattctgttcttcctttccttatatctaggcaagacaggcaaaaaatttttaataaaaataagaaacaaatttaatgctaaacttctgtaattacccaactccccagcaagttttctaatattaagcagaaaaagtataaaaagatacaaatataatatttgcatttttttgagagttggtagatttaggattttacaaagtaacatataataaaagatatttaaactttaaaaatgtactttttagattcaaaactcaaaaatgatttcacttttctaacatttttcttgtcatagtgtttcaaaaatgtagccagatgcggtagcacacacctgtaatcccagcaccttaggaggctgaggtgataggaatgcttgagcccaggagtttgagacagcagtgagctatgaccaccccagtgcactccagcctgggtgacagagcaagagcctgtctcataaaaaaaaaagtacataaatgaaaattaggtaattttcagcagttaattcacctgtgagatcatttttattgttgtctaccttaattcaagtaagccaggtcaatagattaaaatacaaaaaaaatccatgatgaaataagtctgtgcacagtctctgatacatagtacgttttcaatatacatgtgttaaactaagttgtatatattatctatgcctcaccttcctctgaggtacaataccagtgtaaggagaataaagattcttatctatggtttaaaacttaaaacttagaatgttcttacttagaaaccaaattcactttagaaaacagaatttcattaaagtttttttttgttttttttgttttttttctggagacagactctcgctctgtggcccaggctggagtgcagtggcgcaatttcagctcactgcaatctccacctcctgggttcaagagattctcttgcctcagcctcccgagcagttgggactacaggcgcacgccaccatgcctggctaatttttgtatttttagtagagacaaggtttcactgttggccaggctggtctcaaactcctgacctcgtgatccgcccgcctcggcctcccaaagtgctgggattacaggcgtaagccactgcgcccggcctccttacagtattcttaatgggatttcacaatatagaagaagacaggatataaaaaatgtaagtaatactcaattagaaaatctttcctatatatcaccctgagaagatagtgacctcaccttgactgaccctttcctgtcatttatatcccagcacatttttcaccctttctctgtctctgtcttatttccacttgtcaagcaaaaagcaaccttctccagaaatactttttaacctctgacctctcccttccaactctagttgtgcttcatagcactccctgcaggttggataagtgtggtaatcctaatattccataagatgctgtgcatatctttatcattgaataatttatcccctattgttagcattttctttttttgtttttttgagatggagactcactctgctgcccaggctggagtgcagtggcacaatctcagctcactgcaacctcctcctcctgggttcaagagattttcctgcctcagactcccaagtagctggggttacaggtgcctgccaccatgcctggctaatttttgtatttttaatagaaacgaagttttgccatgttgaccaggctggtcttgaactcctgactgcaagtgaaccgcccgccttggcctaccaaagtgctgggattataggcacgagccaccacgctcagccaggattttctttttatcaatttgttttctgtcttcaaatttcataaaagccaggattatgtctgatactgatggggttcaggaaatgctctcccaaaaaacatgacactgtgacatactgaatattttaagctaaagaaatctgagaaacagcatgtgtgggaagcttagccatgaatctaggatgtgtagatatattttcttccctataatatatagtagatgctgtggtgtagtaataaatatttgatctttacccctagttactggtacagaaacctaaaaaccctggaatttactgtctcttatgctaaacagatgatttatggggtggggagagctagacagcatcatcatgggtctgctctgcagaaaaaccaaccacatgattagggagttagagctttcaggcctactccctgacatccagagaggggaaaggggctgaacactgagttcaattgctaatggccaattgtcttagtccctattctgctgctataacagaatggcacagaatgggtagtttataaataatagcagtttattttgctcacagttctggaggctgggaagtccaagagcatggcactggcatcttgtgacggcctccatgctccatcataacaggatggaagggcaagggagtgcccgagataaagagaggatatctgtcaaatccatctcttgatcaggagcctactcccaagataacaaacccacttcccaggtaagtgcattaatcccttcataagggtggagcccttgtggcctaatcacatcttcaaggctgcacctcttaatactgttacaatggcaacatcaagtttcaacatgatttttggaagggacattcaaaccacagcaccagttttcatcaagcatgcctatgtaattaaacccccataaaaaccactaaattacgggatttgtagagtttccaagttggtaaacagatccatgtgctgagagggtagcacactctgactccaaggggacagagactcctatgctcaggatcctattacacattgccttatataccttaccaactggatgctcatttgttatctgttataataaactgataagtatagcactttcctgagctcaatgagtctctagcaaataactgaaactgaagggggttgtgggaacctctgattagtttcagcctgtcagaactgtgagtaactgagagaccctactggtggctggcatctgaagtggggacagtattatgggactgagaccttaaactgtggggtctacaataactttgaacagttactgtcagaatggaattaaattgttgagacaaagttggtgctgaataattggagaatttgtttttggaaaagcacacacaatactcaatacatttattttggataaatcaataaataagtgaaagtgaacaataaatagaagatatattaaactactcatatattttattattattatgcataggcatgtttgtaacactttttagagctagatttttgctgttcttgcaattcatttgtattgaatttttccatatagatagtgcttgcttttatattttacaattattttaacataagtacatgcttttaaactattattttcaagtttaaaaacacttaagccaacatccattaccaaaaccaaaacaaaaacaaaaatcagattctcctttatgaaacacagagattagcatgaatgtacctgcctctctcttaatattatttatcctaagcaacatgagaatgaggattgtgtttaattggaattttcttttccagagattaacagggtgcttagaagatgagaagtgctcactacctgctggaaaataaaaagaaatattatgagggcaaaatatcaaaaagaggaccagaaagtgggaaacgagatagttttctagaaaactgaaaaaggactaaaaaattaggggtggggtataactgaattgggccaaagattataagtgaccttgaagaaagtaatttcagataaaatagcatgaaaagttaaattttggattattttggccaggattgccaaaataatcttgaaaaggaagaataaagttggaaggctcacactttctgatttcaatttactacaaagctatagtaatcaaagcagagtagcatggcttaatgctagacctttagatcaacagaatagaattgagattcaagaaacaaacccttgcttacatgtacagtcaaatgatatttgacaagggtgccaaaacaattcaatggggaaagaatatcttttcaacaaaaggtgctggaacaactgaatatccacatgtaaaagaaggaaactggacccctacctcacaccatacacaaaaaggaactaagaatgaatcaatgacccaaacgtaagaggtaaaaacgtaaaattcctggaagaaaataaaggcgtaaatcttcttgaccttggattaggcaatgtttacttagatatggcatcaaaagcacaagcaatcaaaggaaaaatagataacgtggacttttgtccttcaaaggacactatcaagaaagtgaaaagacaacctacagaatggaagaaaatatttgtatatcatatatctgaagacagttgtatccaaaatatatttttaaaaaacacttataactactcaataattaaaaacaacacagccaggcacaggtggctcacatccataatcctagcactttgggaggacaaggtaggtagatcgcttgagcccaagagttcaagaccagcctgggcaacatggcaaaatcccttacctacaaaaaaatataaaaattggctgggtgtgttggcatgtgcccatagtcccagctacttgggtggctgagggggaggatccctagagcctgggaggttgagcctacagtgagccatgatgtgccactgcactctacccaggatgacacagtgagacccagaccctgacagatggagagactgacagacacacacacacacacacacatacacacacacacacacacacacacacacacagcacaattttaaaatgggcaaagggtttgaatagatattttatcaaaagaagatacacaaatggccaataagcataagaaaagatgctcaatatcattagtcatcagagaaatgcaaatcaaaaccacgagatggcacttcacactcactagaatggctaaaaaacaaacaaacaaacaaaacaaaacaaaaaaaacctaataagtgtttgtaaggatgtggggaaactggaacccttacacaatgccagtgggattgcaaaacattgcagccactttagaaaacattttggcagtttctcaataagttaaacagagttatgtcacccagcaattccattcctagttatatgcacaagagaactacaaacatatgtccataaaaaaacctacacgtatgtaggttttgtacatgaatgttcacagcaacattattcataattattcaagtgttcatcaaataataaatggataaacaaaatatgacacactcatacaatgaaatattatttggtaagaaaatgaaatgaaggctgggcgcggtggctcacgcctgtaatcccggcactttgggaggctgaggcaggtggatgacgaggtcaaaaattcgagatcagcctaaccccatctctattaaaaatacaaaaattagctgggcatggtggcatgcgcctgtaatcccagctactcaagaagctgaggcaggagaatcgcttgaatccaggaggcggaggctgcagtgagccaagatcctaccactgcattccagcctgggtaacacagcaagactccatctcaaaaaaaaaagaaaagaaaagaaagaaaaaagaaaataaaatgaagttgtaatacatgctgcaacaaggatgaacttggaaagcattatgttacatgacagaagccagtcacaaaaaaccatatattgtataattccacttacatgcaatgtccagcgtaggcaaatccatagagagagaaagtaggatagtgggtaatgggagttgggggaacaggaaatggagaatgactccacagggagtcctatgcttctatgctcaggacccttttggaccttccctcattcataccagggttactccagcctgggcgacagagcaacactctgcctcccaaagaaaaaaaaccatgcagaaagggagagtagatagcctgaaagaggttaaaatatactggataaaaaatagaagtgaagtcaattcaacaggcatgtatcaagggcttaccatcttctagacacagagttataaagagttataatattagggatataaaggtaaatggaggaattcattaagttgagaaggcttaacaaacctttgcctccaaagaagtcaacacccaaatgatccaaatgaaattacaactgcttttaaggttggaccacagtatttgccactacttaattattgaacctctctaagattcctaacctgtaaagtgaggaatggagaccctagatcactcacttctaaaatttgaagagtcaaaacaatgttggtagactagaaattggaataataggtcaaaatccacaaaaagcatgattatatgtactccattaacatgattataaaactcttgaagtgatactagtatgtactcaagaatatcattttcaaaagaaaaaaattttaacatgattgaatatgaaatctccaaaaatacattcttagaaaatctaagaatctatatgttttccttcattcattttagactacatgaagtttggaggacagaaagctcaattctacaaacagcagcctaaaatgctaggaccaaaattcacatacattagtaaaatatctttcctttaagatttagaaacttaaagaatttctgagaaacaaacagcttcacaacattactaagaatataaattagctccacaatgttatttaaaaggtcaactaaacctagctgctcttactaagaatcagtaagggaaatctgaatttgattcctagatttactatacactagctttgtaatcttgggcaagttactgagtcacatctcagtttcctcaactgtaagtagaacaaatatacccacctaaaagaattcttgtgaggattacacaaataaatatatggaaagctctaacagcataacatcgatgtggtcaaaagatgttgacagataatttacagaaaaaaataaaagagatcagtctggtcaacaaagtgagaccccgtctttacaaaaaataaaaacgaacaaataaataagaaagaaataaagctgaccaatacatgaaaataaactaaatcttgcagagaaatgcaaatttgaacaaatttgagttatcatcatgcaccaatcagattatcaaaggtttaaaaaaaaaaaaaaaagaacccagaattggtagttttagagtgagtgtaaattgataccaccactctgaaaggcagttcagtaacaagtataaaagttttggccaggcacggtggctcacacctgtaatcccagtactttgggaggctgaggcaggtggatcacgaggtcgggagttcgagaccagcctggctaacatggtgaaaccccgtctctactaaaaatacaaaaaattagccgggcatggtggcaaatgcctgtagtcccagctacttgggaggctgaggcaggagaatcgcttgaacccaggaggcagaggttgcggtgagccgagatcacgccactgcactccagcctgggctacagagtgagactgtgtctcaaaaaaaaaaaaaaaaaaaaaaggaaagtgtggccaggcacggtggctcacacctgtattctcagccctttgggagaacaaggttggaagactacttgagcccaggagttcaagagcagcctaggcaacacagtgagaccctcatttttccaaaaaattttaaaaattagttgggtgcagtggtgtatgcctctagtcccagctactcggaaggctgaggcaggaggatcacttgagcccagggggtcaaggctgcagtgagccatgatggcaccactgcactccatcctaggtgacagagtgagatcctatctctaaaacaaatttacttaaaaaataacatgttccaaaacatattattgattaaaaaggaaaattacaaaccagtagagtatgaccttatttttataaatgtgtgtgtatatttacagggaagagcatttaccacgttaaagaggttagctccaaatagtagaattttaagtgacttaactgtctttaaaaaattatttctgcattagttacactttctgtaagtatgcattacctttataatcagaaaaaaactattttgatttctttaaataaatttgaaaaacaaagaactaaaagaggataccagttcttggtccaatgattgttttcactacacaaaatgatctgcttgatccaagcaaatgttcagttagggaggaaaaatactttaaatgtgccctaagattagagaaacctgacagcctagggaaagatgaaaaataataacaattatgtgacaagactcaagaatatctctatcttaaaacgtatctgcttcagtttagattgaccaaagtccttttatacaccacaagaaataaaagtaggtaccttaatgggaaggagaaaggctaaagaaatagctaagaaacttactaaacacactgaaacttataatactgcttttcaagctattcttaaagtaattaaaagaattattcaacatgagaaaagaactagttcatttatgttagaggacttaagtaatttaaagaaagctacatcaaattgtctgaaacctcacttgttttcacttgtcattaattacctaccaagatatcacctgctgacaaaaagaaaaacctaaagacatagaaactttaactttccctagtatgaacacatgaaaactgttcttttcccttataaaaactctagtgcttagctttcttatttgaattcaggaaagagtactaaatgaagacaaaaattcaaagcaaaaggaacaacactgaacaacagagtcaagaaacagactgtggtttcaattttctactaactcttaattttataagtaaaacaagaagattgacaagagcttcaaatacttttaatggaggatcagtgatacaatacactctttgaaaaattcacagttcataaaaaaaagaaaagttctatggtaaaataagttcagaaaattgtgcacaccctttgccctttttggagatccataatgcagaacagaaaatacttctgtataacccaatgtttcccaaaatgagagacaaacaaaatgtccctcaacaaaggaatgatttaaaaatgcttacattagacagatcaacgagacaaaaagttaacaaggatatccaggaattgaactcagctctgcaccaagcagacctaatagacatctacagaactctccaccccaaatcaacagaatatacattcttctcagcaacacatcgcacttattccaaaattgaccacacagttggaagtaaagcactcctcagcaaatgtaaaagaacagaaattttaacaactgtctctaggaccacagtgcaatcaaactaggaatcaggattaagaaactcactcaaaaccgcttaactacatggaaaccgaacaacctgctcctcaatgactactgggtacataacgagatgaaggcagaaataaagatgttctttgaaaccaatgagaacaaagacacaacataccaccacctctgggacacatttaaagcagtgtgtagagggaaatttatagcactaaatgcccatgagaaagcaggaaagatctaaaattgacaccctaacgtcacaattaaaagaactacataagcaacagcaaacaaattcaaaagctagcagaagacaacaaataactaagatcagagcagaactgaaggagacagagacacaaaaaaacccttcaaaaaatcaatgaatccagcagctggttttttgaaaacatcaacaaaactgatagatcgctagcaagactaataaagaagaaaagagagaagaatcaaatagacgcaataaaaaaatgacaaacggggtatcaccaccgatcccccagaaatacaaactaccatcagagaatactataaacacctctacgcaaataaacaagaaaatctagaagaaatggataaattcctggacacatacaccctcccaagactaaaccaggaagaagttgaatccctgaatagatcaataacaagctctgaaattgaggcaataattaatagcctaccaacgaaaacaagtccaggaccagatggattcacagccgaattctaccagcggtacaaagaggagctggtaccattccttctgaaactattccaatcaatagaaaaagagggaatcctccctaactcattttaatgccaacatcatcctgataccaaagcctggcagagacacaacaaaaaaaagataattttagaccaatatccctgatgaacatcgatgcaaaaatcctcaataaaatactggcaaactgaatccagcagcaaaagcttatccaacacgatcacattggcttcatccctgggatgcaaggctggttcaacatacacaaatcaataaatgtaatacaccatataaacagaaccaaagacaaaaaccacatcattatctcaatagatgcagaaaaggccttcaacaaaatttaacagcccttcatgctaaaacctctcaataaactaggtattgatgggatgtatctcaaaataataagagatatttatgacaaacccacagccaatatcatactgaatgggcaaaaactggaagcattccctttgaaaactggcacaaggcagggatgccctctctcaccactcctattcaacatagtgttggaagttctggccagggcaatcaggcaggagaaagaaataaagggtattgaataaggaaaagaggaagtcaaattgtccctgtttgcagatgacatgattttttatttagaaaaccccatcgtctcagcccaaaatctccttaagctgataagcaacttcagtaaagtctcaggatacaaaatcaatgtgcaaaaatcacaagcattcctatataccaataatagagaaacagccaaatcatgagtgaactcccattcacaattgcttcaaagagaataaaatacctaggaatccaacttacaagggatgtgaaggacctcttcaaggagaactacaaaccacggctcaacaaaataaaggatgacacaaacaaatagaagaacattccatgctcatggataggaagaaccaatatcgtgaaaatggccatactgcccaaggtaatttatagattcaataccatccccatcaagctaccaatgactttcttcacagaactggaaaaaactactttaaagttcatatggaaccaaaaaagagctcgcgttgccaagacaatcctaagccaaaagaacaaagctggaggcatcacactatctgacttcaaactatactgcaaggctacagtaaccaaaacagcatggctacagtaaccaaaacagacatagagaccaatggaacagaacagaggcctcagaaataatactacacatctacaaccatctgatctttgacaaacctgagaaaaacaagcaatggggaaaggattccctatttaataaatggtgttgggaaaactggctagccatatgtagaaagctgaaactggatcccttcctcacaccttatacaaaaattaattcaagatggattaaagacttaaatgtcagacctaaaatcataaaaatcctagaagaaaacctagacaataccattcaggacataggcatgggcaaagacttcatgactaaaacaccaaaagcaatggcaacaaaagccacaattgacaaatgggatctaattaaactaaagagcttctgcacagcaaaagaaactaccatcagagtgaacaggcaacctacagaatgggagaaaatttttacgatctacccatctgacaaagggctaatatccagaatctacaaagaacttaaacaaatttacaagaaaaaaaaaatcaaaccaccacgtcaaaaagtggacaaaggatacgaacagacacttctcaaaagaagacatttatgcagccaacagacacatgaaaaaatgctcatcatcactggccatcagagaaatgcaaatcaaaaccactatgagataccatctcatgccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttgacccagctgtcccattactaggtatacacccaaaggattataaatcatgctgctataaagacacatgcacatgtatgtttattgcagcactattcacaatagcaaagaattggaaacaacccaaatgtccatcaatgatagactggataaagaaaatgtggcacatatacaccatggaatactatgcagccataaaaaaggatgagttcatgtcatttgtagggatatggatgaagctggaaaccatcattctgagcaaactatcacaaggacagaaaaccaaacaccgcatgttctcactcataggtgcgaattgaacaatgagaacacttggacacagagtcaggaacatcacacactagggcctgtcgggtggggggaggggggagggatagcattaggagatatacctaatgtaaattacaagttaatgggtgcagcacactaacgtggcacatgtgtacatatgtaacaaacctgcacgttgtgcacatgtaccctagaacttaaagtataaaaaaaatgcttacacatcactgtataatccttttaaagaaaacgtatttatatatattcacatggcagacttctgttgcataggtagaatatataatcaaactgcagaatgcatatttaattagattttaaaaaataagtatatatattcatgtgcatattaaaaaggtctgaaagaatgtacagcaaaccattttaaagtagttctggaaactgccatcagcagggccaaagggaatatatttactttatgaatggacagatttgagtttctccggtaagaatatatcgctttgtaatacaaataagtagccaccagaaaacataaatgcactgggtaagttcacatactttttttttgagactctgtagctcacgctggagtggtgtgcgatcacggctcactgcagcttcagcctcccaggttcaagctcagcctccggagtagctgggacagcaggccagcactacaacgtctaaataatttttgtattttttttaagagatggggtcccactatgttgcccaggctggtcttgaactcctggactccagtgatcagcccacctcagcctcccaaagtgctgggattacaggtgtaagccactgggcctggatgttcatattatttaaaataaatcttttcacaacaaaaatctattggctcttttataaatatgaaatttaacacatttcttctaatacaatgtatctccaggttactgaattaaagacttcctaagatattcactgaagcgttacctataaaaatatacactgggaacacttaaatgcttataataatcaatagttaagtaaatgactaaatatcaacccaagagaatttttcaatttgcctattttgtttatgaattgcctacagttttataaggattttgaaagctaactcaacaaaaaataatgtgtataattatatagaatacatagcaatacaaaatacttatacatataagtaaaaaaaattccaatgcatatttgtgttattttacctgtaaaaaatatgaaatatattcttttttcttttcttttttttttttttttgttgagacggagtctcactcctgttgcccaggctggagtacagtggcgcgatctcagctcactgcaacctctgcctcccaggttcaagtgattcttctgcctaagcctcccaagtagctgggattacaggtgccagccagcacacccagctaatttttgtatttttagtagagacagggtttcgccatgttggccaggctgatctagagctcctgagctcaggtgatctgcctgcctcagcctcccaaagtgctgggattacaggtgtgagccaccacatccagctatgaaatatattctttcataaattgagcaaacatcatgcaagtcatgtatgtttaccgcttatgaaacagactgcaggagtcacagcacttgccaatcaagaagcttacagtcaagtggaacaaacataagtaaatcaattattatagtacaatggcattcattcattccataaaaacgtatgtagtgcctactgtgtaccagatattgtctagatgctactcatttgtgaacaaaaagaaaaaaaaattcttgccttcttcatggggagagacagataacaaaaatataaataaaaaaacatttatagcatatttgaaggccataagtatatggggtggaaataaagcagaaaaagagagagtacagggcagacggtttatttttgttagtgttaaggtaaagagtcatgtggaagtgtacatctgagcaatggtttgaaggatgttaagaacaagctataaggttatttgaaggaatagcaaatacaaatagcttgagggaagaatgtgtctgataagtatacaagaaacaacaagaaggttagtgtagctggcccagagtgaagaagaagtgtattaagaaataggggagaggtaaaatgctgcgaggaagatcatgtattgtagggtcttgtaaagactcttgcactgtaagatcattgtaaagtcatggtggggtgtgaacacaggagggatgtaatctgatttagggtttttttttttttgagatggagtcttgctttattgccaggctggaatgcagcagcacgatctcgactcactgcatcctccatgtcccaggttcaagcgattctcctgccttagcctcccgagtagctgggactacaagcatgtgccaccacaccgggctaatttttgtatttttagcagagacgcggtttcaccatgttggccaagatggtctccatctcttgacctcatgatcctacccactcggccttccaaagtgctgggattacaggcgtgagccactgtgcccagcctgatttaggttttaagaggatcactttggttgctatgttgataatagactcttgggagtaggagcagaagccctagaaggctactacaaatatccaagaaatgattgtaacctgggccatagaacagtgaaggtgatgaaaagtggtgagaattcaaatatactttcaaagtagagtcaacacaatttgttgacgccttataagtgggatatgagaggagttaagatacagaaaagaagagtcaagaatgtagacaagaaaggagtcaaggatgacaggacatggtttagatctgtgtcctcaccaaatctcatgctgaaatgtaatctccagtattaaaagtggagcctggtgggaggtgattggatcataggggtggacttctcatgaatggcttagaaccatacccttggtattgttgttgcaatagtgagttcttgggagatctagtcatttaaaagtgtatagcacctggccctctctcgcttgctcctgcttttcactatgtgatgtgccttctccccctttgcctgctgtcatgattgggagcttcctgaaacctccccagaagcagatgccactatacttcctgtacagcctgcagaaccataagccacttaaacctcttttcttataaattacccagtctcaagtatttctttaaaacagtgcaagagcagactaataaaatagcgttttcttggtatgtgcagtaagaatgagttgtcactaagatggggaagactgttacagggatagacttggagtggtaaagtcaaacttttgacactgaacatgttaaatttaagatgcttcgtcagtgtgcaggtagagaagtcaagaagacaagaagacaattggctgtaagagtaaagtggcttgctccacttcaaagaatgtgataggaaacttctattttagggatatagttgcaaaaaatacaatgatttacaattaggggatccatcttcacagattaaatattgtctggccctcaacagacacataaaaaaatatggcaaatgaatgtgaaaactgtattaaatgtttacatttatatgcatatgtattttttataatttcctgttttgacctttttgattaaatgaatagctatcaaatccaactggattggataagaagtctgttgctgtacattttgcaaataatggttaaaagccatttttaaatatgttaagtattcatactagaaatattctaaatataatggttaacagacttctactttctccttaattgtctatttctgatacccagaattatttaataaaatcagttaggtatttcctatgtgttagttttataactgtaatatagtgatgccttcattcaatgactaggactttgtccctatgctaaatggtgccagccagactgctttcaagtttttcagtttcctctcttattagaaggcttgtcagctgtgacctgcttgctgcctaaatgcttacttaaagctaatcttttcaactttattggcttaaataaatgacttttttctttacatgtctacttatgccaaatttttggcaaaagtcacctttacattgctaactcagaaactttaagtatgagtaaggcagatttcatactcagaatctgaatgtacaagtcagtcattttatatgtgcttagaagtagattattgtttttacactaattattttacaacatcagctttaactttaaaatttcacgttaaacctaagaacccattgctatttactattaatttattgataatctatacgttgtggtaattatattacaattataattttttatatctgacacagcaaaaaagaatttgcgaggatctcaagactaaaagttattacttaacccttgaaaatgtctgttttattttgtgacccaaacagttttgttttgattttttgtagggaaagtgctaggctatagatacaaacctgctgaacaaaaataaataaatcatctacacagaattcagaatttttcttataaattactactaaccttgctaccaagctaccttaaaagtgttaccaattttcagttgaaccagtttatcaacttcaggcttctaagtttcctactgaagaaaaaaaaatttaaggaagaccaataattattacctttgttctgtatacactgatataaatgaattatttatcttgaacattaaaagacttaaatcctagcactttgggaggctgaggcaggaggactgcttgagactaggagttcaagaacaacctgagcaacaaaatgagatcctgtccctacttaaaaataatataaaacattttttaaaaactaaagaataactaaaaacatattgaaaaattaaaattattccatatagaatatacttaggcttgcataatataaactctaaaactaaaaaataaattgatgtataaaagctaaaatttagattttccacttacagtttgatcttacaagatcttacaagtctgaagagttcactacctaagaaataaaatttctctcctccctcaagtacatcttccagaatgccaatagacataccttcctaaaacctaaacctcactaaacctaatcatgtctcttcccctttttaacaacttaatgtaaaaatgggagaaaaaagctttaataatatcctatcacctgcaactttttttttttttttgagacggagtatggctctgtagcccaggctggagtgcagtggcgcaatctcggctcactgcaagctccacctcccgggttcacgccattctcctgcctcagcctcctgagtagctgggactacaggcgcctgccaccacgcctggctaattttttttgtatttttagtagagatggggtttcaccgtgttagccaggacggtctccatctcctgacctcgtgatccgcccacctcagcctcccaaagcgctgggattacaggcacgagccaccacgctcgacgcaactttcttaattgcctatctaaacctcaccttccaatgttatttgctagcacttcctgcaatacctgaactttaagcctgcctgtcctttcccactttttacatctggacatacttcaattcactcatcaaaaattcactgaaatctaaactttttaaccagctaatatttactgactaaattaccaagtttaaggcccagtgctgtgttgtaaatatgtaactcttaagatgcagtccttgccctcaaagtttaacaatctggtgaaattctccctaaaaccttacccctctcagggctaccttttacattaaatctaattctccggatgtacttatcatactatatagtaattatttacatgactgttttcccctactagtctgcgaacagaaagaaaagtaaccacgttattcatctctgtagttccagcacctagcaaaatgaattaccaatagtagttgctcaatgctgcaatgaattgtatacaatatatcaagagcaaaaacaaaaaataacaaaaaaaggccaggagcagtgggtaatgcctgttaataccaacactttgggaggccagtgtgagcgtaccgcttgagccctggagtgttaagatcagcctgggcaacatagttgagacccggtctctactaaaaattacacaaattggccgaacacggtggcatgtgtctgtagtcccagctactcgggaggctaaggcagaaggatagcttgagtctagagtttgaggctgcagtgagctacgattgtaccactgcacttcagcgattgtaccactgcacttcagcctgggtgacagaccaagaccctgcatcaaaaaaaaaaaaaaaaaacccctgcttgccaaatgaaacaaaatgtgacaacaccttaccattatataaccatatttaaatgagccttcattttcatctacaatataagatatatttatgaattaatggtgaatcatctcaaccaacaataactccaaaataggctgggtatagtggttcatgcctgtaatctcaacactttgggagatcaaggtgagagaatcacttgagcccaggagttggaggctgcagtgggctatgattggtcactgcactccagcctaggcaacagagtaagatctacacacacacacacccctcttaaatatgaccatagtccattatttccccaataaagacaattctttactggggagggtccatcccaaactttgcagatgtttagcactgctggccctgcagactcaatgtcaatagctcggtttagtcattatgacaaaccaaaacatacaacacattgaaaatgctccctaggtgaataagcagcccctgaggtgagaaccattgcttagctttgtggctctttttgactttatttacaaataaatcatatattccatagagaatgctcgccatgcatctctaaaacaaaaacaaaatgtaagtaaaattaaaattgtagtatgaaattatttcctcaaatactgggaacacattttatatagtcagccactctaccttagggagatatacataagcaaaaagactaaaggcaggctgaagcagtaaggacgagaaagaaaatatggcatctaaagtctacatgcagatgccagaattaaacaaactaatttcttcaaaagtaggatattcaagatgatcttttaaaatgtgggaagaaatcataaagaatctaacttttattaagagaacgagaaaaatttgctaactactaatatttaacacatggatgaagactgctgccactcataggattgaatattaggctttttatggcaagctacctggcaggaagagtgtgaattccacattgtagaggagctcacagtggtatccttactcacactgctcagaatcataatttatgggtctacaatgaagtagatttataaattataccattctaagccaactttcataaaaaatgagggggctttaaaaagattccttccaaaaaaaaaacatagattaaacataatactagttaacagaatcacaagaaataacacaaaatgccaaagctgatgcttttgctgctagttatcagccacactgtgaggaaaaaatgatgatctcagccaaaaaaataactataaatttaagaagaaactatttgagttacagtatttattattgttaacaatcgccttagtttctaattcactttgagaaactggctaataagaatataaagcattcacaattagcaaaatatcttaagacactgtttatataatctttatctcatcctatttcatttatatttattagtgtatatctgacataaaatactaggatattagtaaatgtatataatccataaacaaatatacatatactggtgatccatgctccaaaacatttttactgattggaaacacaaaatagttctaagaccatcaacatataagacaggagtctaaaataatgtagtctaagaagaatttcccaaacctttaagtcaaccagatttaaggatacccagcaaggccgggcccgatggttcacgcctgtgatcccagcactttggcaggccgaggcaggcagatcatttgagatcaggagtttgagaccagcctggccaatgtggtgaaaccccatctctactgaaaatacaaaaattagccagccatgctggcaggcgcctgtaatcccagcaacttgggaggctaaggcaggagaatcgcttgaacctgggaggcagaggctgcagtgagccaagatcatgccactgtattccagcctgggaaacaagagcaagactccatctcaaaaaaaaaaaaaaaaaaaaaaaaaaaaaaaaaaaaaaaaaaaacaacccagcaagaactggctattgttaatcttccactcaaaaaaaaaaaaaaaaaagtaaaaatgcctcaaaaataggccaggtacagtggctcacgcctgtaatcctagcactttgggaggccaaggtgggtggatcacctgaggtcaagagttcaaggccagcctggccagcatggtgaaaccctgtctctactaaaaatacaaaaaattagccaggcgtgatagtgggcgcctataatctcagctactagagaggctgaggtaggagaattgcttgaacccgggggggtggaggttgcagtgagccaagatcgtgccacttcactccagcctaggagaaagaacaaaactccgactcaaaataaataaataaataaatagatagatagatagcttggatataagaattaaaaaattttaaggcaacaatcagtgaaaagacgctttaactcagggtcctaaagcaaaataattccaaaaaggtgtgctagtccctaattgcaaagatgggggtgggcacggtagaatggaaagaagcaaatttttagcaatctctagtagttcttctatttacagtctggactttatcagatttatttacatttcaagaggaaaataagaagtgtaaaacagcacttttaaaaggcttctaactagcctttaggaatcatttttacatttaaaatttttattttttaaacatttcttgagttgataaacatataacattaaatatgcttacatttaatagtattttaaagcattcttatcagagtataagatctacatctctgtttctaggttcacttaagtagtatctgtgaaaacattttgtccacagtgggctgacatgaaataatatcaaatctcattgcctaaaacttttgtagatgttactacctatgaataaaaatcacattataaacatttaaaagtataaccattacacagaaatgaacagttcttttccaactattaagaaagctctttcctaaaagctttctaggcaaatgaacaactctgaagcaaatgaaaattaagttccagactctttttttctgatcaacaggcttccattacacacttacttccattaaaacaggagttgtaatgggacatggtaactacaggtgaagagttatctcattcatttcagttgctgggtttcttgccagttccccagtctacttctgtttctatggcaacaaaggtaggataaggaaaacagaaggaacactttaagataacagctaagtggggaaagtcaaagtattgaatggcatatacagtaatttaattttaagaaaataatctaaaatataaaaagaaggaaattgcagttcatacaaccttaaaaatactcaaagggaggaccttgccattccaatattttttccttgattgttttcatgaaaacatatttaacttttactgataacttttctagaaatttgattccactcctactatgggtggcccaaaactcaaaaaaacagaaaccagaaatcaccaaatgtccagattcattttccagcaaaaatcacagtactttaagtaatgcttttttaaaaatattctatcacattttgtgatcctagttaggaatttactttaaactctttctttaaaataattgattctaacatggccctttaagctaagcaaagcagctacattcaagctttagacgaggctgggcagcaaggcaagacgctatctctacaaaaatttttaaaagcagccaggcatgatggtgggtgcctgtattcccagctactcaagaggttgaggcgtgaggatctgttgagcctgggaggttgaggctgcagtgagtcatgggtgcaccaccaaactccagcctgggcaacagagtgagacctgtctcaaacaaacaaaaaaacaaagaaaaagaaaaaaaaaagaaataaacccatctgttaatatgaatctttcatatagatatactgcatatcaataaattacatataacgtgtctagaatagaagtttcttccgtagatttactaagtaattctgggatcatgttaagtctgtaaatattcagtatcatgaattttatttatttatttatttatttttagagacagggtcttgctatattgcccaggctggtcttgaactcctaggctcaagccattctcctgcctcagcttcccagtgctgggattacaggcgtgagccactgcacgtggcccaatatcatgactttaacagatcttttaaactgcttgttctttttcaagttgctctatgttcaaattatcttctttcctctttcacaacattctcattctaaaaagagactctgtctctctctcaactctcacccactcactttggtggaagcaagctgccatgtcagacacagcaccatggaaatgaccatgtgatcaagaactaagtcctcccaccaacagaacagggacaaggaaaaaaggcgtgccaagaactatatgagcttggaagcagatcttctagccccagttgagccttgcaatgactgctgccccaactgacagcgtgacagccacctcttgagagatcttaagccaaaaccacctaactaagccactacgagattcctgaactacagaaactccaataacaaatatgttttaccctgttaagttttgaaatatttactaaacagaattagataaattgataaagtatcttattcatctctttattccctctcaccccaacactgagttccttgcctggagaagatacttagcaaataaatgatgaagcaaagccttaagatttgtgatgcagtttggccaaaactcatgccaaatgggcttactctactgctaagggaaacaaaaatttaagcccccaactccatatgaaaactaaagtaataaaaagaaaatacatgttcacttaataaaacatatgatatgctaatctgtaccatcagagaacaaagagtatgtccaaaatctatatttccacctttaaatctatcattattttcctcagtgatcatgcaaactttgaccaaatctctgtattttatctttgtagaatctggaatgtacttctatgtattccatcagttgaaatcttacccctcttaggataatgttcctgcgaggaaaaattatggaagactttaacaaagggaaaaaaaagattatgtcctatctagggcatcataccaagttatctgtccctttcactatcctttttgttttgggggttgttttttgtggtaaaatacacataccagtagtccccacttatccacattttcactgtgaggcttcagttacgagcagttggccaacgtccaaaaatattaaaatgaaaattttaggaatcaacaattcacaagttttaaattgtgtgccattttgagtggcatgatgaaatttcatgccttccccctcaaacctgcctgggacacaaatcatccctttgtccagcatatctactctataaacgctacctgcctgttagtcacctaatagttgtctagttattagattgacaaaacatagtcatccactgggggttaggcagcatccactgagtgtcttggaacgtatctcctcggggacaaggcagggactactgtaatataaaatttgccatttttgccagttttttaaaaagcctacattctcctatccaagtactaaccaggcctgtccctgctttgttttagaaattagagatcgagcacatactttaaccatttttaagtgtacaattagctggcattaagttcattcacaatactgtgcaacctccaccactatccatttccaggcctttcaattctctttgaactaaattctcagacaataaaaacactgaacttctaatattctgcatgtgcattaaaaaacaaaaagtcggccgggcgcggtggctcactcctgtaatcccagcactttgggaggccgaggcgggcggcctaccttgtggtcaggggatcgagaccatactggctaacacggtgaaaccccgtctctactaaaaatacaaaaaaatcagccaggcgtggtagcgggagcctgtagtcccagctactccggaggctaaggcaggagaatggcatgaacccgggaggcggagcttgcagtgagctgagatcgcgccaccgcgctccagcctgggcaacagagcgagactccgtctcaaaaaaaaaaagtaattagaaaaactaagtattttagtttttaatcttaagaacccaagtttacaaaagaaaggtaaatctttggcaaatgggactaatttaatacattctaattttaaaaatttatggctttaaccaatcggacaagctagcattaatccttaaagtttacaacatgaaacagataaattctcatgttcaagtaaattgagtcattattttgacagtttttttttttttcttgacatgtaatcttgttttgttgcccaggatggagtgcagtggcgtgattatggcttgctgcagcctccgcctcacaggctccagggatcctcccagctcagtctcccaagcggctgggactacaggcgcgtgccaacatacccagtgaattttttgtagtttttgtagagacagggcttcaccatgttgcccaggctggtctcaaactcctaagctcaagctgtttgcctgccttagcctcccaaagtgctgggattacaggcccaagccaccgggcatggcccaacaaatttttatttcaacagtaagtatattttgcagcatggcagcttgaagataattttcaaatctttaggtagcctaaaaccttggactgatattaaataattattcaatgcgtaataacttctaagcaaaatactgaaacattgattactatgcatccttttaaacatatacttttttttttttaaacggagttttgctcttgttgcccaggctggagtgcaatggcatgacctcggctcaccgcaacctccgcctcctgggttcaagcgattctcctgcctcatcctcctgagtagctgggatcacaggcatgcaccaccacacctggctaattttgtatttttagtagagatggggtttctccatgttggtcaggctggtctcaaactcctgatctcaggtgatctgcccacctcggcctcccaaagtgctgggattacaggctaaacatacacttttgtttcttgtttttatatactaatgacaagctgttttaggtcatgttagtggaaatgtcaatttttgccactttaagaggcgaaaaagaggtatgcgtgctgtaaaaagtggtgttgtgtgtgctcatgaattctactagtctgctaaaatgctggtatatgacacagttctcaattattcacctccaacttttctctgtaaaacagaaattagtcacttcgactaaaagttacaattaatatgattcattgaaatctgttatgtaagtttagcctaaagctgcctctttacatattttaaattcaacctagaggcttctctgtacattctgaactatatctaacaagcggaggtactatcagtccatagcccactcttgtgccaatcacccagttttggcatatcaaatgtggccaactgttccaactgtgtttaactaaggcaaataccaagctgtaaccaatccagctatttctgtacctcacttatgttttctgtatgtcacttcctttttctgtccataaatcttcttccaccacttggctacgctggagtctctgagcttactctggcttgggaggctgcttgattcgtgaattttctttgctcaattaaacactttaaataaatttggctgaagtctttcttttaacagactataccaggagcaacaatgacatggaatcacagctcggtatgtgcatttattttaaaggaaaaggagtagtattgtcctaaagaacggattcttgtgcattttggtctcctggcctctttacactcttaggacttgttgaagactccaaaagagttttcattgtacataggttgtaagtcttgatgtttaccatattggaaattaagactcagaactattttaagcgcttatttactgtttcatttgaagacaacaatgattaatatattgcattttagcaaattttagtatttttataaaaatatgcgtgacaccacagatcctgttagaagcacggccctaaagtttgttcaagaatataaaagacaatgaaggacctaacctagaaagtaaatttgtcttgatttatagcagctaacatagaaaagaagctaccaaacattttatttttgttttttctccatttatttatttttttctatcttttaattttttatttccatagggcattggggaacaggtgaggtttggttacaagagtggtgatctgtgagattttggtgcacccaacacctgagcagtatacactgcatacaatttgtaatcttttatccctcagccccacttcctaccctttccccctgaatccccaaagtccactgtgtcattcttatgcctttgcatcctcgtatcataacttagctcccacttatgagtgagaacatacgatgtttggtttcccattcctcggttacttcacttagaataatagtctccaatcttatccaagttgctgcaaatgccattaattcatatctttttcatataatgacttcttttcctctgggcagatactcagaagtgggactgctggatcaaatggttgttctacttttagatctttaaggaatctccacactgttttccatagtggttgtactagtttacattcctaccaacagtgtagaagtgttcactgttcaccgcatccatgccaacatctattattttttggctttttgattatggccattcttgcataagtaaggtggtattgcattgtggttttgatttgcatttccctgatcaatagtgatgttgagcattttttcatgtttgttggccacttgtatatcttcttttgagaattgtctactcatgtccttagcccactttttgatgggattgtttttttcttgcaaatttgagtatttaaaatgttcgaaacattttaaagtttagaaaatttcactcaacattgatggacttgcttccttagaatactagttaattccttcatcttcaatgtgaaaggctattctataccttctgtgtaaagtgactaaatagcagaaattctgtatcctaacagaataactttctgtgcttatgttgagttcattatgtccttgatcatctaaagaaacaaaaatgaatagcttcctcctcaggtatgaaacaggtaaggtcttactttttaaaatttttttttggtggagtcttgctccgttgcccaggctggagtgcagtgacgcgatgtcagctcactgcgaccttcgccttctaggttcaagcgattctcctgcctcagcatcccaagtagctgggatttcaggcatgtgccaccacaccctcaggtgatctgcccgccttggcctcccaaagtgatgggattacaggagtgagccacctcctccagccaggttttcccttctatgtgtatgtttattgttactttgattaaataagtaaccaaagcttgtttctcaggcagccacgactctatctcaatcaaaccccaaatatcctaacaactctctatttgcattcccccaatcagatcctaaatacagaaaaataaaactttcacaatacactaaatacactaaactatctttcagatttcccagagtgcctcaataagaccacatagacgtattctttttttttttttttctgagacggagtctcgctctgtcacctaggctggatgcagtggcacgatctctgctcactgcaatctctgcctcccgggctcaagcgattctcctgcctcagcctcccgagtagctagtactataggcgcctgccaccacgcccagctcatttttgtatttttagtagagacagggtttcaccatattggccaggctggtcttgaactcctgatcttgtgatccacccacctcagcctcccaaagtgctaggactacaggcgtgagccactacgcctggctgacttattctttcacctcataaaaaaagagctgctggaaagaattgggtttacttgatatgttactctcataagaattgcatgggaacagtgtcaaatcaaaagagatatttagcttttcctaggttaagattatatagataacacattattagtacaaatatttcagaaaacttatgttttatgagaaatccctgggaatgtgtcaatgtctttactgtccattataatttcactcttgggggaaatactgatcaaaaactcaagaaataattacagacgggtgtggtggctcacacctgtaatcccaacactttgggaagcccaggtgggtagattacaaggtcaggagtttgagaccagcccggccaaacagaccagcctggccaacatggtgaagccctgtctctactaaaaatacaaaaattagccaggcacctgtaatcccagctacttgggaggctgaaggagttgcttgaacccgggaggcagaggttgcagtgtgccaagattgagccactgcattccagccagggagacaagagtgagactctgtcacaaaaataagtaaataaataaataaaatatagctgttaactgggtgtggtggcaagagtgaaactctgtctcataaatacatacatacatacatacataaaatatagctgttaactgggtgtggtggctcatgcctgtaattctagcactttgggaggccagggagggaggatcacttgaggaccagcctggccaacatggcaaaaccccatctctactaaaaatacaaaaattacctgggcttgggggcacacgcctgtaatcccagctactcaacttattgagcaactgacgttttacctagagtgtcatatttgagaacgatgcttacttaaacaggtacaagttacttttaaggaactaatgttgactttacgagccctccctggaaaactagcctggtccctgtcttacagggactcagccttttaggtgataaggaagatcactttctggcaggccacacaaacttaagaaatctgagggactgccgagcgcggtggctcaagcctgtaatcccagcactttggaaggctgaggcaggcggattacctgaggctgggagtttgagaccagcctgaccaacatggagaaaccccgtctctactaaaaagacaaatttagccaggtgtggtggtgcatgcctgtgatcccagctactcaggaggctgagacaggagaatcgcttgaacctgggaggtggaggttgctgtgggccgacattgtgccactgcactccagcctgggcaacaagagggaaactctgtctcaaaaaaaaaaaagaaaaaagaaaaaaagaaatctggggcctggcatggtggctcacgcctgtaatcccagcagtttgtgaggctgaggcaggcggatcacaaggttaggagatcgaggccatcctggctaacacggtgaaaccccatctctactaaaaatacaaaaaattagccgggcgtggtagcggaagcctgtagtcccagctactcgggaggctgaggcaggagaatggcgtgaacccgtgaggtggagtttgcagtgagctcagatcgcgccactgcactccagcctgggcgacagagcgagactccttctcaaaaaaaaaaaaaaaaaagaaaagaaaaagaaagaaagaaagaaatctgagggataattgggggtactatagtaggtaaaatctcgtagaatgtcccaggcttgctttctagcctgaggagaggaaatatcagtaatttttaaatgtcctagctcagattccttagaaaaagttcaaaagttaattttgtagctttagtagttgtacatagtgcataggctcaaggatacgcacaagttaactcaaggaagcctgtgtagttaatatttttgcacacctatgtaaataagccatacctcatgagaccggccttttgggggtgatcaggaaaaatctttaagataattattgtatgatcacattgctacaaaatcttaccagaaccattcctgccaaacaattcagaaacaaatataattccctaacaaatttaggaatatatgattatccataaaaatcaagaatatacaaattaaaataataatattcccactgttaaaaaaaaacgaaaaaatattctcaacttccaattgcaagagtatacaaaatgatactaattcttctgagggggatttttgtggatatgtgaaaagagcctttaaaatctgaataacatacattcacatgatcttgtcccgaaatccaccaaacaggacaaaaaggaccaaaattagtgtgggaaccagggaaaataccagtactcttttaataagactgattctatatgcatatgccctaagagggcaaggttcacaatttagtaagtaagagaatattcagaaatgtcctaacccataactttcatagttgccgtttagaatcatggggggcctataaaaagaagtggggggaatcacagatcttgggacacatgtttgcagagcagaaaataatcgagctacttttttggcctcatcgtttttatttttctcaacctttcattagagttgaggagacagctttgaaggtgaggatcaaatctgactaagcagacaaaagctctgactcatcacacaaaactcataatccacaggattacagagagtcattctctccctcctcccactcacatcttcaggtgtgccaagttctccctaaagcagggaaactgctaaaatcgaagttccaccctcacatatagaacaacagcaaagatctcaagagactcagagaaaaagttctaggaaaaaatatatgtaaactatacttcctgttgcctagctcttcttgcctcttattccaaatatttaaaatgatcaacatctatacctgtagcacaaatcataaaacaaggaaccaaaaaaaccccttcaacaacactgaggtaaacaagcattaccagtttcccaagcatttaataaaattcaacttcctttcccgatttttaaaaagtctaaagaatcacttgcacctgggaggtcaaggctgcagtgagcctagattgtgccactgcactccagaatgggtgacagagtgataccctgtctcaaaagaaaaaaaaaaaaggctgggtgcggtggctcacgcctgtaatcccagcacttcgggaggccgaggcaggtggatcacaagttcaggagttcaagaccagcctggccaacatgcagaaaccccgcctctactaaaaatacaaaaattaggcaggtgtgatggcaggtgcctgtaattccagctactcgggaggctgaggcaggagaatcacttgaacctgggaggcagaggttgcagtgagccgagattgtgccattgtactccagcctgggcgacaggagcgaaactctgtctcaaaataaaaaaaaagatagaaatagatgcatgcttgcttaacatgatctttaaaaatacatataacaaaccaaaaggtaatatcataaaaaaagtttaagtactagaatcatttccaaagtcaggaaaagagtgcccaatgttaccaatacattgcaaatagtagtcagcttaatttcattctttatacaataaagttacaaatactaaaggtggcaaaattatctttgtttgtatatgattatatatctagaaaaccctagaaaatcaactgaaaaattattaaaaacaataagagtaattcaatcaacagtcggtaggatgttttggggaaaactggagtcttctggaagaaaaataagttgggaatctaaacttcacttctttcacttagactccaccatgcataaagatttcagtttaaagcaagataaacctaggagccataaatgaaaaaaatgatacactggtcttctatacccatatttctcgctatattggaaacaacagtctaggggtaaaaaaattccaccatacatatcagaaatgggagtaagaaacaggaagaggaaaggaggaaaaggagaactaaaatagataacctagcattggtatgctagagcttgctcatagtggctcacaagagtcaactgataattcttgggaattcttgaaatctagttgttaaaaacaatcattattaattaaattatataaacttacagtcaataaattataatagggtaataaacactcaaaacattacttcctaattattttgcattttattatttatgctgtaggaagttatttacatctatagtatggttatgatgaaaatactatacaatgattgtacaactacatttctcaactttgttcaatagcattaagttgtaggattgaaacaggccatggtggcagtttttacacaagcaaaagacactacaaatcaaggctctctttgccacatatacaaaccagttaatattttccagaataccataaaatattcatattctttgacccagcaattcaagctctaaaaatgaatcctacagaaataacttagaataaaaaaagctgagggatgtttgatgatatttcatcccatcatataataacataaagtgaggctaggcattgtggctcacacctataatcccaacactttggaaggctgaggagggtggactgcttcaggccgggagttcaagaccagccaggtcaatatagtgaaacccaatgtctaataaaaatacaaaaattagccgggcatggtggcatgtgccactagtcccagctacttgggaggctgaggcaggggaattgctcgaaaccagcaggcggaggttgcaatgagccgagatcgcaccactgcactccagcctaggcaacagagcgagactccgtctcaaaaaaacaaaaacaaaaacaaaaaacttaaatgccctaagattggataaattatgcagtcttttaaaatacttaatgacaagagaaaatgctcatgatataatccaaataattaagagctaataaacaacggagaatgcaaaaactacataacagctacttcgtaaaaatacatacattttaaaaatggaaattaaaacttgttttatttaaaatgccgtaaggaggcatttctgttagaagaaatgctaatatttggaactaggactctctgaaatttctttcctcaagctccaatttcaccactatgcattcccacattttttctttccctctagttacaatgaaagagtatccctcgttctagttcgtgattatcagtctaacatggatctggaacccatttcttcccatttcttacagaatctctgaattatatcctctgcccctgtatcttcattcaccctgttaaaaaaaaatcatcttcctatatttccttcccagaaactaccaaatttcttttcctcctccttacaaaaaaaaaaacaaaaccccaaaactatttaaacatgtttccatttctatagctttaatccaaaccactccactgaaactattaatgccaaggtcactaatgtccttgtcacttaatccagtggattattttagttctttcttaggtaataccacagacacatttcactctatggccactcctgtcattttcatcttttgcaggaataggttcatgacactaacctgctgtttcattaatgaacaccttcatttcagtaaatatttcatttcaacataaaacaaactaataatgcatatagtagcctgtgaataatagaattttgaacatttgaaatttttatcaatgcttttctgtatttttaaaaacttttattaatattttatagtgaagaaatacatttttaattttaaagaaaagtcaaaggacaatgaatatgattaactgtaagaaggaataagtaactggcaagttgtacagctgcatatacccttttaacataaacaggcaaatgacacaaatatgatatgggaatttattttttttaattccaagttatattctcaaatagtttttttccctttcttatacatgtattttatattttattttatttttagaggtaggagtcttactatgttgctctggctggtctcacactcctggcctccagcgatgttcccacctcagcctctcgagtagctgggattacaggtgtgaatcatcatgcccagctatttttaattgacacataataattgtacatatttgtagagtacaatattttgatactcaaatagttttaatttaggcatctaaaatgtaatagaattacttaccagtatgataagcctgccttatcaaagaagcatagtttgaatactctcaatatatttaataaaattagtattttttcaaaagattcctgtcacaagaggttgaaacaaaattacaaccaaaacatgacaatgctttaaaaaattgacctttagttatctagctcaacattccttataatagaaattttagagaatacaatatcacatgaaaatatggtatagataaatgttgatgggaagttgggccttaacataggcataaaaggacagttttactagcagaaaggaatgcagaatcattaaatgtcaaaaaattaaaaatatgagaaataactataaaaagtttggtgaggagggcatttttcagcttaaaagtaggaaaattattgttaaatctaaagaactgaaaagttaatatattttgtgtgtgtgtgtgtgtgtgcgcgtgtgtgcgcgcgctaggagagagagagagccaggatcacactctgttacccaggctggagtgtgtgcatgcacaggagagagaaagagagagagacagagacaggatctcactctgttacacaggctggagtgcaataatagctcattgcagccttgagctcctgggttcgagcaatccttccacttcagcctcccaagtagccaggcctacgggtgcatgccaccacacccagctgatttttttttttaaattttgtgtagagaccaagatcttgctatgttgaccaggctgatcttgaactcctagcctcaagtgatcctcccattttgggcctcccaaagtgctgggattacaggtgtgaggcactgcacctggcttgataagtgatttttatttatttccatgggtagctgtaggattatttttagctcacttttaaagtgctgagattataaatatagaaataaacatgtatttttacccatgtacatgtaattaatttagttggtacctgcagtatattaaatgctacttggaacaaataaaatatttgcaaaaataatctatttcacaaaaggtggctcatattaaaatgcaaaaggtcaaattcaaggtactacgtcacagaacacttcattataaaaaaaaaacagctgggcccagtggtgcatgcctgtagtcccagctactcaggaggctaagatgggaggatctcttgtgcccagttcagtccagtctgggcaacagagcaagaccctgtctctaaaaaattaataataataaaaatttaaaaacagtaaacttctggtcacattcaatttagcttttcttcccaggcatgccttattcctaccttcccatttcacacacagtacaaaaacattttcacgttctttaaaacaattcttctcttttgtgagttttggcaagtgtacctacaaacaggcttcctgcagcgggaagggcaaagagagcttttatctaactgtctaaagttattacatgttctcttcctggaccaagtgtttactattcacactgcccttccctaacccttcaacttttacttcaaatccccaaggcatgattacagataagagttatttacccaacaagctgcagaaaatattaatgacaaggcacagaaatttaatgctaaaatacttacactactatggacaaaatcttgatatgttccaaaaggacttgattacataacaatgctccactctgactgcatttagaaaccttatttaaaattgtctccttttttgttgtttctgcccaaaccctaagaacacttaactttggctccaaagtaacccctcttttaaaataaagagatttgacccacaactctgtcagttaatgttgccttgcagagcctgtttttctcagcatgctgcactaacaacccagaaacgaagaaaaggtcattttgtgacttatacacggctcctgattttttcaaatgttgaagataggttttggtgcttcctatgtcatcacaatggtttatgttaacagtaatacattacccaaagatcagaagcatgtttcaacaaccatgtcatcatagaaaccagaaaagatagtaagcatggctttgaactaaacttagacactagataactttttatttccactgttttccatctttaatttacctcaaaacttatccttgtacaagataaaaaatggttacataaaagttttaaggttttcttatgacaaatctcttgcaagtaaatgttcatcacaatactgcaaataaaacatttaatatgcaataataataaatttcattattattatgatgtagtaataatgaagttaggaaaagactaactactaaaatttattgtccttggccaagacattatgtaaaagatctttcatacatttgtgttttgaaaattttttaaatctttcctttttcatactcttttttagtgggatttctatttttttttttttttgagacggagtctcactctgtcacccaagctggagtgcagtggtactatctcagctcactgcaacctccgcctcaaaaaaaataatttttatatttttagtagagacagggtttcaccatgttgaccaggctggtctcaaactcctggcctcaagtgatctgcctgtctcggcctcccaaagtgctgggattacaggcatgagccaccacgcctggccctcctttttgtccttatggatatgcccgttactggcagtccagcagtctgcttgtcttctgcattcatccgaaggaactaaaagaagtaaaagtgttttttgagccagagccatcatcatggagaaaagggatacacatatatcaccctctgctctctactcaatgttcttagcaggggggatcatgcattagatttccagaaaaactgttcacaaaagcataggaaaagaaccaaggaaaagggaggggttctggttaatctcaaaacagaagatttgaatacctctaaccagaaagggtagttttgtcagttttaacccggccttcacaaataagcctatcactgaaatggaggattgaaactgattaacccatcttctccagaaaaagccaagcagtcaattttgaaaggaaggatcccatgacattttcttttccttctagtggaagaggtatgggttggggtgaccttgaaaaggcagaaccatcccagatgtcaaatggattggctctaatatagagctctagctctatatttgttctataataggcttatgcagtccttcttttcttggatcttttcttcctgatctgtgaatattcaaaatttaattgttcttgatctagttcaatgctacctaaaccgaagggccttttctaattattccaatgagaagccatctctctcctactatgaacttccataaattgttatccatagctctcccagagcatgcttggagatagcattcaataaaagcttaaagaatgaaggtagatgcctcctccttttcctattattaatactagaataatacaaatgtatcaaatatgtgcaattctgtggtggatgtcactgagtcactttactttttcaaacaacgtctaaattttctgttttgctgggttactaatacagtatagaaaaattcagtcaggccaggcgtggtggctcatgcctgtaatcccagcactttgagaggccaaggtgcgcagattgtttgagtccaggagttcaagagtaacctgggaaacatgctaaaaccccgtctctacaaaaatacaaaaattagccaggcatggcagcgtaagcctgtagtcccagctacttggcggactgaggcggtggggatcccttgagctcaggaggttgaagctgcagtaaactgggatcgtgccactgcactccagcctggacaacagagtgagaccctgtctccaaaaaaataaaaagtaaaaataaaaatccagtccattaactcacccttcttcttttctaaatataattatgtaatgagaaccagaaaaggcagacaaataaaatcccaaacctgcattttagtcaaaaactaagaacccctcttcatcaagaagtggggaaggcagggaaaaccagatttgtttgaattttccttcctttattctgtgatgagatgctaaagagcagagaaataaatgaaaggacaatagtcaaaagggagtgaagaagacataaaataatttacaaaatgcctgatataatctcaaataatggaaagttaactaattatagttatgatcctatgcaactcaaaactaaaacacaatgcatcatcctttaataacctttggatttgttgtttaaaaaaaagtacagcctactatcagctggattaaatttggccatatattctgttatattacaaacctatccagccatttctgaagccaagaaagagtaaaatgcactcttaggactggtactcaaccttgaagtgctgagagctacttcatcatctagtgtggggacaaacacatacatgcacatgtgagcctaacaccatgtgtggaaacgcatcattgtaaatcactcaggtattcacttattttaatatacacaaatcaaagcacagctccctgtgattcctaaaaggagagctgaaatagcatttaacattttctcctcccacccttctcactaaaagcttgagacacaaaggtgttctcctctttccttacagttattactgacaacatgcaggaaactattatagctggcctaacttaccaataccacctaaatactgtaagagcatacctgtgcttaatactccagaagtgactcaaaaagcaaaagagactccttattagatttcttctaaaaaactagagtaactctatagttttaggattagcattattctaatccagttataaagtcatgccaattttcccttctatcttgctttacaccaccactcataagctaaaagtattatactacttttctacatattagatgacattgttttagactaattaatcacaatctactgttaatgttgtttcccaaaactatgtataactagtaaaatattattagcaatatttccaaatccaggataattctgttattgatctatggacaaaatcataaaacacatattccaaaaattacaatagttgtataatctaggtttgtttggttgattctggccgtgacaggtaggacatgaccttttacacttgtttccttcaaagcttcttcattttattcagcattaagtttaaattaaatatttaaaattgaacctgttctgtgttgcaaacacagctaaaataaagagcttctgtagcagcagtgaccagattttaaatgcaggtagatcaataaaaaaaaaaaaaaatcaccaagcacaggctccatgtgagtggaatggtttataatagcttgcaaatgactatgtgcttgctgtaaccagctgttcttaaattatgaatatgcaaccaattcatgttaaagccaaatcccagcactatttctacagagaaatcccagtagttttgcttgttctacatgttagctgtgttaaggatacaaatagcagtaagcttctgaacaaataggaccgaactattggcatttcatgcactaggtccattatcacagcaggcaatgtcaatcattggtacattcctataacagctcaggcaatatgacaatgatctcataggaaaaaaaatcaaaatctctgcagcatactcaaagtccttctgacaacctaatgctttcttactacagccaatcagattgtcagacctgacctactagaagactttcaccaagcttgaaacatttaaaaacatcaatcataaaaacaaagacaggacactgaattatacagtattaacctctagggtttgcatacaaagaccttagatttatttatgtcctagcgagttaagagcttcagtacaccgttctttacaccaaactgactgccaatttgatgaacctctctgccctcagcaggagtgcaccgtctttgattaatgagtgcatgtttgtggaaaagtgttaagaggagaaaacaggaaaaaacacccaattatgtctacacatagctgaagtactaatccaagaattatcttcaaaccaaatgctcctttttcttatataccatgcacacatgtgcacaacacaaaattagtaaaggttcttatctatgttgccatcattattattatccccaatatgcaatagtttttatttgaatgaaaggcattcaaaagccaaagtacaagttgaattttataaattataaaaactatttttaaagcgttatcttttaaaacaaattgaaatactcttaccttatatagtaaaaatttaagtatgtggaataaaaactatattttcacctcatattcttataaaaccctattaaggttaaaaactcaatgtttaactgtaaatatccatacttttaaatattttatatttcaaactctattatgactgccacaaatcaaatagcactcaaaatacatttaaaagtcatatatattcatttacttttcctgttttcaataaacatgtggccaatattttataactcaatatgcagttgaaaatgaattaaatatatttattacccataatttcatacttaatacggtcaacagaaaaaactgtaaatcaaagtttgaacttttaaaatgacctttctattgagaattaccttccttctagaaatctgatgcctgaaaattcctacttaaactacaggatgtttatgtgtagtacaattaagactatattatctctaaagataaactaagcatcaggagtcctttaaaaaaaagttcacatttcatacacaattcaatgttccttaatttgatttatatgaatatctacctcaacaaaaatatgttatgagtaaatacatttcttaaatattgagtcatagtcaaaggtaacagaatgattttctttttaaggagttgtatggctactatgtaaaaagggttgagaaagcataatgtctgaatataaatcttagctttagtcagtaatgtacaacctatttaaaaggaaagggtccctataaactttgatttcaggaaatcataattctggaatcaatggcataagtgttaaaaatttatattgtagaggaagttttgagcaaattatatattctaatcaatttcatattttaagtatttatttttgtaatggcaaattattttaagtgttacaaattttatgctctttgaagaattatttaaatgcctaatacacctaaagacctacaaattaaaagtcaataaatattgggactagaaaaattctcttaacatagtaataaataaactatattatatccttaaatcttatttacatgaattttttaatggatgtttctgtgttgggattatcacttttcattcttcctcttttctccctcccatttcctctaccaccaaaaaacaccatgcaaataattagaaaaagtagaatatatgtaggcaccaatgggatgacaccattttagtatcacatatttagtatgacaccattttagtatcacatatttagtatcacacattttagtatgatagctgaaactatcaataaaagttataacaataaaaatataatttcattttttaaaaatcattaaatgtctactagtaagttattttagatcatagtttgtatgaatttttaaataacattttagcctcattataaagaaaaattaaatacaaaactgcctctttccccaataattatttcttttcttttgtgattacttcctagaacaaaagtttaaagaaacagccaaatggattaacatttattaaaaaggcaacagtatttttaaaacttcatggtaaaaaatacttaattttatgtaaccaaaaaaactcttaaaatacctaactaggtaacttaattaatcccccaggaaatcaaatatattaataatcactaaaacttgatgacgtaattcctcttaagggtcaaaatcaccatattaatttgtgctaaatcatatctcttcttttggtagttctactcagaaactacaacttaagatcccttctctgagaaacctttaaacctaaaagtaatcaagttccaaaatatactttcactaattcaaggagataagacagaaatcctgaactttcatgcaactgtgatatcctacatcttgtatagtaacacaaaagtagcaacaaagacattaacaattgcagttcaagctgggaatgactgttctgtttcaattcaatgacaccactaatggcttcttagcagctccatgaaatcaaccagctgtcaagttgatgcatcagaaggaacagttatgcactcccataagaaaaagcaacacatcaggatgtttggcaaaacatctgctcctttacactgcagttctataataaacatgcaaacaaagaaatgggagaaagggcaacagaattaaaattctaaggtttccattacagtcttatgtgcattttaaatgaatggcttataaaaaataaaaacaaatttctaccaagttgaatactttaagctattcccaattttttgaaaatgctaaatataattactcagagactgttctagaaagaaaaaacctgcataagaatccatctattctaaaaattgtaaataaacaatattcaagtaaaatcagtatcataatgttatgtataaaactcaaaaattaaaactaaaatatatccttccttcatttaataagtatttcataaatgatgccagcagtattccaataaatgcatttccaagactgaagagtttagaagtattttttcattagtgtttgtaagagtaaatggtactacaattcggcactagtttaacatgtgagaacagtgaagctactattatctggattttaaaatatgtacccattcctgtttctctccaaccattataagaacacaatattaagttctcataaataactttgtatttttaaagcatacaatctgattttctaaaaaaaaaaaaaaaaaagactcttcatcatcgtaggcttaaaataattttaaattcaaccacttgtttcaaatacttgtaaaaattacttttttctatctgaaccatacgagtgtcttaatgttgtccaaattactgattatgcagcagagtgacaataatatgtacagtgtttacaataggtgtgagacatcaaatgtacttaactaccattttcttaaactgcttatcctctgttgcttgccatttataatctgccaaatcttctagtcctttgttgcatgtataatttagaaccatctgttctatgtgcttttaactatttaaacatttttcacctacctacaattcacataaatggcagacactcaactcagtcaagctttctatatagcatattacatgaagcaaattcctggataaatagataacaccaaagaagactgctacagaaataaaaacttaccatatagaacataaatttctgtgtgttacacaaaccttttcaatgtattcagaattgtttctattagctttttttaagttaattgtagtcagtgtttttccctcaacccagaagacaaagagaatgcaaattaaatacagacagtttcatgtccttgttagaagagatgtaaatatgctgactgaaaatgactacaggagacagaattccactttcccattcaatatacagtgcctcttatttatatactagtcagtgtatcattaagcttggtcatgtgaccaaaccaacttttgtgaggcgaaaaactatgttagacaagcaaattaaaacagtgctagtttttgtttatctgttcataatggctgacaaagagtttatagctagcgattataaaataacttttaaaatcaattctgcctcttaaatactcaataattgtttgacttaatatctgctactaaattttaaagtatccattatcttaaggtattttccatagtcatttcttttcaaaatgtaaataaataatagaaaaagaaaaccccagaacattttattagaaacggggagccagataatctaaaataaccatacataaatattaaccaagctaattttcaaaaaatccataagggagagtggagcaaataagaaagggaatatactgactacagataacagttgaaacctttaaattaaaaaaaaaagtacacaaaaaccagataaataacaaatgacgcacaagttttttaccattttttgcatataatcttccacctgttaccaaaacatacaatacgcagacttcgtatactgattttgagagcaaaacacaaaaataagccacacaacttatcagtaacctgtaagttacacaatcctataaaacaggagaaaaattaagcaaaaaatttactcttgggaaaatttctccgtaaagtttacatgacgtcactgggccccctgaacattccctaaactttgagacttatccagacacacttcctaatacttctttcctttcctcaaaaataaaaaagagagagacttgggaataaaattgcccaagatggcgaaacgcttgttgtttagagggcaggaaaaaaaatggaggatattgtaatatacacaaagggataaatttcaacaactcggccaaggactgcagctgcttccctctttataaggaagcaacagacaaaagataaatacagagggagaaagaaaagaagagaaaatctcccaaacaacagagccagctctgactcttcaaacacttccttccccttctcaaatcccaattctggggttcgtgaaactacttaaaggggagggagccgcgaaagagaacgggggctggggggaggggtagcgacaagaagattaaaagagggaagcagaggagttgggagctggcggtcgttcccggggaagaactgctaaaacatgagaccaaggcacagaccttactgtatgagaagcaatgctcctcaaaccttctgcgtgctgacatagaccttcccaggtatccagatcttttcccaatcccacctgccccacccccacccccgctcatcttcagtaaactcagagcctccagctacacacgggagagctagaggcccaagccggggagtgggggtggcagacgcagctcgtcagtccgacagggaagagggggcggaggcaaaaaagggcagcaggaggcggacgggggtggggggtgatccagaaactaccccggcagggagtgggggagcagcggatattccggggtaggaacggccatcgcaacgctgacagaggttgttttttaagaagcaaaactgttggcggcgacctgagcgctggaagccgaaggggaagaggaaggagacgcgaagccagggcggccggcacaaaggcggcggactcgcggcggcagcgcctgcccggccgggagcacaacccacggccctactccagcgaagtcccgcaccggcttctaggaataaagtttacgttctcctgaggccgcaccccccacctcccacccaggacggcacatctccgtgtcctcctcccccaaactccactcgggaccccgagaaccaccccagccttccggccaccacaacaaagagccgcaccgaccggcgaggataaacagcggcggagggcgagagggcggcggggcgagcgcctccacgcagcaactccggagtcccccgcttgcccgagcgcagtttctccgctgctgtttccaccggctttgtaacactgggaatttacatcctcacccgcacccctcacgcccgaggattttaaactcacctttactctcgaactgagagttgcggtagatgggatttttgccttttccccagatggttgaaggttaagatttttggaaaccccaccacctccttatttctattattatttctgcaagaaaagtataaagagagttgtagtggaggtgagatttgtgatcgggaaagccttcgactccctccttctccgtcttccgcctctctctctctgattagttcctatccagcagcagattgaagcaggagatgattcttctcaaggtttgttcagcagcttcacttctaggcgaaggcttcatgaaccaagt

SEQ ID NO: 503 - DNA, 3148 bp, Homo sapiens
ttttccactagaaactatatttacttataaagggaaggcaaagacaagaaaagatggctgcagattaaactttactcgtgtcaacaagtttactgtaggaaggatattttaagcaatttttttcaattataaacttactttcaaaataggtatttttcatgccataaatttgaatgaaattaacacaagtaattttatgctgctacagtttttattgttcattttccaacctgtattccaagtcttggggtcccctttaatttgccttattgacaaagctacttcccgctgcccacccttttctaaagtatgttcttccaaaaccatgtagcttctgattgctagcttaggtacaacctgactacagttcaggaggacgttgttttaattctatatgaaaaacactttctatttcaagagtgggagcctgtccatcattggtattagacaaatctttaaggacagaattgatttttgaaacctcttcaaattttgcttcaccttccaaaacaaccgatcctaattttactgctggaattcctgccacctgcggtgactgaaattctgtagacacattctctaccagagcctcatcttcaggggtttgttcagatggtggaggtgaaacttcagcagaggcctctcctataggaaactcctcagtcagaagcaaatcagctggtggggaatgtttgtcaacggaggcctcttctgcagggacatcatcagctgggggagagtgtactgcagcaagggtctcttctataggagtctcctcagctggtagagactgaacttcagcaggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcaggagcctcttctgcagaagcctctgtagctgctagaagctgaattgcagcagaggcctcttctgcagtggtctcttcacctgatggaggctgaagctcaagaggggcctcttctatagaaactcccttagctgatggagactgaacttcagcaggagcctcttctgcagaagtctcctcagatagtggagactgagcttcagcaggagtttcatctgcaggagcctctatagctgctagaagctgaatttcagcagaggcctcttctgcagtggtctcttcagctaatggagattgaacttcagcatgagcctcttctgcagaagtctcctcagatagtggagaccgagcttcggcaggagtttcatctgcaggaggctccgtagctgctagaagctgaatttcagcagaggcctcttctgcagtggtctctttaggtaatggagactgaaattcagtaggagcctcttctgcaggggtctccatagctgttgaaagctgaagttctcgagcctcttctctaggagcctcttcaggtaatagaggctgaacatcagcaagggtctcttcaacagtgggaggctctactttagctggggcctcttcaagggcgccctcagctggtaaaggctgtacttcaatgggagccttttgtgctgagggagaccgaatttcaccaagaagctctactgaaggagacttttcagctggtggaggcagaatttcagcaggaggctcttctgaaggggactcttcagctgatggaggcagaatttcagccagaagctctacagaaggagactcttcagctgatggaggctgaatttcagcaggaaactccactaaaggggcctcttcagcaggtggaggctgaactttaacagaattctccgcaactgcagtggctgcctcagcatcaggagtctcttcagttgatggctgtacttggacatgggtctcttcagcaggtctgggctccgctttagcagtggcctcttcaactaatggaggctgtattttagctgggaatttttctgttgatggaggctctatttcagcagaagccacttttttaacagcagaaccttcttgtacaacaggtacagttacttcttccctaagctcatcttctaaaagtaccgggggaccttttttagtctcctgagtaaatgaagttctgctgatatttttctgcccaatttcttcattgctgtttgttgctggttgaaattcagggtgttcactagcaaaaatctttcccgacgatttatgtttcagggcatcttcctttgactttgtagaagaactatctggcctggaaataaccactatttctgattcactaaagtatgtctgttgttccttgtccactttttctacaggggggatgttcatcatggtccagtatcctgtacggctggtctgctgagatctgtccatttttagttgaactgaaggtatgtttggtggaatttctacatcctgaacactctctggcaattcaatagcagcttctctaacatcagctgacttttcttcaggtaccacggtttcctcaactaacttgacttcttttttctcttctacaatggtgtctgtctggagagacttactagtcatttcctgtccatgctttctctttgtccaagtttgctgaagctcagaagatactctaatagactcataggctttggcagagtagctgcctttgcttccagaagtattaccaatacgatgggtagctttggggctagatgattttggtatggccatgtgtttctttttctctattacatcagtttgctgggatttgcctaccattggtttgctgggtcatcttctctttcgaatttcttgcctacacgctgagataggctgattagagtcatcactttcttccatttctaagagtagtgatttcaaacttattaattttcaagtaatgaccaaaaatcacaaacgtaccaagtgtcaaagactttccctttcttaggtgtcattctgttgagctccctcagaaaaaaagtaattcataagctattgcattccatactacactcttgttggatcccaccttattcagtaagcgtctttcttctttagtctctgttataactaaatatcactttt

SEQ ID NO: 504 - DNA, 123950 bp, Homo sapiens
ttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 505 - DNA, 120427 bp, Homo sapiens
ttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 506 - DNA, 2540 bp, Homo sapiens
gtgtttttgaagatttatttcagagtgagcatcagcgacctacaagaacctgggacagaagccaatgcctcccgtttccctgtgatgtgaaacaggaccctgtgcttcctgtggacttcaagaaatgtggacttgagctttgccatcccttcccctgatcctgtttcatagattttgctgttatattctctgtatctttacagggatcgggaggctgaattagtgttattcagggttagtaactgtcccttccttaacggtggtggtcctgatagttcgcacatttttggctgtcccaaagagcagtgcaattatgaaggcgtaaatacgaccaaagaccactctcagatacatcactgattgctggctttgtttgacggaacgtgttctttttggaggtggcccgctgttgacactcccaccagcacctcttcttaggcacagtggaggatcccagcctatatggcaatggcagttccttctgttgttgcagactcctctatgaccgcacttctgagggtggcagttgtagcccagtgaagtgatagtcacattgcactgggtgttattacagaagtttccatgaacacaaggagtgccatctatcacacgcccaacatcagtcgtgtctgttgcatggtgttcatccagtccaaaacactgaaaccctcctctcactgagtgatggaatgaaacacgttcctgcagccggggaagatgggtcacattggtacactgcagtcttccacaaaacttatctattcctgcacaagcctggtagctgagatatgtttgttgtctaatacaatgtccaaatcggtagctttcaagatttatgtcatagcagacctcgggagcatcctcagcactgacaccaaagatcgccttgcagagcacattgcgatcagtgcagttcccacgatagcagtagccttcttcagtgcacggggttccatcttgcatataaacgtttgcgggacatgtcacggtggtcccgtgacagtactctggaaggtcacatatattttggataggtctgcagagagtccctggtggggagaagctgcagtttgtacagcactctcctatatggcagatgctccccggtgttaagtgacagtcactttggcagcaataactggcataacactgcttgaaggagccacagtcacattcctccctcccctccactatgaggtttccacagcgaaccgttgtcatggtttcgttatacacaggagcaagtgtttcaaaaacacaccggcctgaatgtataaaacaattttgtgcatgtccataagaacagttactgaacgcatctgtcatcccaggaaatcgctgcataatgcaggaggcccttctctgacatgtgcagtagttatcatcatactccagaccaatacttctcatctgtgtctgggttattatgacggctaccaataaataatgtctgcctggagtaccaatgtgtaacagggctatacgggaacagaagttatacctttcaggttcatagttagattcatgtggcacgtatttaataagtagtgtggatgaatgaacatgaaaagtatcaaaaaaagttgttttaaaataggtaaacattgcactctgaattcgatattcattcacaggggctgggtcacgattattatatatggtcaaaagataaatatagtaccgcagatcaatattttgagcaatgctgtcaatgagactgaacatctggaccacctctttggaacaagttgtaatattgccatatatgcgataatatgaattggaacattgaacgtggccttttatattgcctctatgagaactatacagcgaattagatatcctgggattcatgctgtcatttgcttcagagaacagggggtctgtctcattgtcatcatctctaaatgtgggccctgttgcgttgggctcggccactatctgaaaaacaacatgttcaaacctgcgggaatcctggaggggtttgatttcgtacgcaaggtcgtccagcctcatgatgcctctgaggtccccatagcacgtgtcgacggtgaccatggacagaggcacctcctccaggtagccgaggtactagcagtctggagggatgtaggggtcacccatctgcaagactccttggtcatcctgagttgtcaccagcagatgtctaggccaaagaaggtgtttcctccgcatgtgaatgacgtgtctttgaccccaaaacacaggctgtaggacagccagccgggaaactgaaggcctttgctatggtgtgtctccttcctgggaatcaccacctcggaggaggcatagtgccacaagggacggccttgagaacaccggaccggagccaggagcgcccagagccccagcagcaagaggggggtcctaagggtgacccgcgcctctgcccgcctcatgtcccagcccagcgatagtcatccaaagacaatgggaaaggaaaggactgtcctgggcgaagccaggccccaaccagctgcggtggctgcgtccctcccagggagaccctgacagagaac

SEQ ID NO: 507 - DNA, 21455 bp, Homo sapiens
ctgactaacgtgggcggagctctagctcgcgtattctgaggaggcggggttggcctaggcgaagatccggactctgggtgttttgctaccgtgaccgtttaggtgagtggaatagccaagaacatttcggcaaataacaaaaacaaaacgtgcggtcacttgtgagtggatgagaactgtgaggaaacagcctctcagcccggttcgtttccggtggtctcgcgtttgctgagctgtcgcctggctttctaaatctggtcccgggtgtgtggcgagggtgacgggtgggatgtgtgcctgagtgttttgtaatcctttgtctatttctgccttcagaaacccttgtgtgttaaaatattggagaaggctcattctttgaccatgactcgaagtgtgtaacctttgtgctggacgccagtgttattccatagcacgcccaggtctcctccccacttttgcacctgtttcgtaagctcaccctttctgcctcccaggagttggctaacatgtcacaagtgagacctgtggaggatttgtttttcctaagtttcctcctacatcccccctgccccacaccattagttccttgaccggttcctgagttaagattaaacagtgtaaactagtttagttttggtggggtttttttctcccaaagtaatttttttttttttgagaccgagtttcgctcttgttgcccaggctggagtgcaacggtgcgatcttggctcaccgcaacatctgcttcccgggttcaagcgattctcctgcctcagtctccccagtagctgagattacaggcgtgcgccaccatgcccagctaatttttgcatttttagtagaggcgggggtttctccatgttggtcaggctggtctcaaactcccgacctcaggtgatcctcccgcctcggcctcccaaagtaattttaaaaaggaatgaactggtttgatttttccgctttcaaaattctgttttcatatgataaaccacaaaaatcagtaaagctgtctagtcttattttatagttcacattttaggattgaacgggccttaaaagtaatctggtctctttacctgctttgctccatagtttggacaattccggggataaaaagtccgatcctttaggcagcccactgcatttgatccacagggtctgggcaatgacgaagctccaggactggtatggcatgtccctcactgccgtattcagcagcaagcctagctgtgtaatttgtgaggctcaatgcaaaatgaaaatgcagcgtcccttgttcaaaaagaaggggaaaagtgctattaaagggaaggaacatttaactcctaatgcagaatcattgaaatttcacatttcattttgtattttttcttttttctttttttttttagaaacagagtctcgctctgtcgcccaggctggagtgcagtgtggcccgatctcagctcactgcaacccccacctcccgggctcaagagatccacccacctcagcttcccaagtagctgggactacacgcgcccgccaccacaaccggctaatttttgtacttttagtagagaccaggtttcaccatgttggccaggcaggtctcgaactcttgacctcaagtgatccgtctgcctcggcctcccaaagtgctgggagtacaggcgtgaatcaccgcgcccggccacatttggtatttctctgtttgtgttatagagacagggtcttgctctgccacccaggctggagtgcagttgaagcaggatattcctctgaccccttcgtgggtcttgcggctgcggtgcctcacttacttagcccacggctctcaactcctcgcgggagggggggcgcgagtgaatgaggcgggaactggagtgctggaagccacgaactccagtcacccaggcctgctgcgctccaccctttatgggagggtgcgtgggggtgagcagatgctggagccggagcgagcgcttttggtcgccggtaggagcgaactccatgcaggccctgcggctgtgtctaggggatgcccgcgacccctgaagacccacagcctgtcttacaacctgtcatggttgtgaaaagttttgagagaacgtctgcacagtgtctaacggtgtctggtatatagtgtgcactcaaatggtaaccagtttagttgcgatagttggtctacccctccaggtgttaacctctgcagctccgtttcccttctagaccctatttctgggccatcgactcccaccaattaggcaggaaaatactgtttgcctccatctggcccaaggctgtattcctggagtttatgtgagaacctaactcctttctcagctccaactgtaaccctctccccacctccaacacacacataaacactcacatacacatgctaccacactgcctgctgtgccatcagcctgcctgaagttcacatcattttagaattggacgggccttcataatttaaattttattatgaaaaagtgatagtctaaggaactcatttgatttttttgtctaaatgtcaaatatagagtagaacgcacaagtgtctgttatagaaatacttgagagtcctatatgcactgttatccacaaccatttaagcacttatccactaatccctaataagtacccctaataagtacatttctaaaccagttattcaagctacatcctcccaagattggactttgtttctactttggtagggacataaataaacggaaacaactgacctaactttttactaaagagataataaagggaataaaattaagattacatttggattttaacttgtgttcttattcctactgccagcaaaaatatgtaaagtgtttttatcattataaatgaatatactattcattgtgcagattttgacatgttcataaataagttagtacccaatgtttgcttgataaagaatgtgataaaatgttaacatttgggaaatctgggtgaagaatgtataggaattatttgtatgtaatatttgtcaatctgaaattatttaaaagaaaaagttaaactgtctcattcctgaacaattataaattattcaacccaaaactgaagggggcctgcccctccacacctgtgggtatttctcgtcaagtgggaagagagactgagaaaataaataagacacaaagtatagagaaagaacagtgggcccagaggacgggcacactcagtatgcgaggacctgcaccggcactggtatctgagttccctcagtatttattgattacttttcactatctcggcaagggaactgcggtgggagaacagggtgatggtggggagaaggtcagcaggaaaacatgtgagtaaagaaatctgcgtcataaataagttcaagggaaggtactgtgcccagatgtgtaagtaggctagattcatgtttctctttacccaaacatctcagtgtagcaaagagtaacagagcagtattgctgccagcatatctcccctccagccacagggtggttttctcctatctcagaatagaacgaatagtcggctttacacggagacattctgttcccagggatatgcgggaaacagaggccttcctcttttactaatccttctcagcacagaccctttatgggtgtcaggctgggggacggttaggtctttcccttcccacgaggccatatctcaggctgtctcagtggggggaattcttggacaatacccacgctttcttgggcagaggtccctgcagctttctgcagtgcatcatgtccctggttaatagagaatggagaatggcgatgacttttaccaagcatacagtctgcaaacatattgttaacaaggcacatcctgcacagccctaaatcccttaaaccttgattcaatacagcacatgtttctgtaagcacagggttggggctaaagttacagattaacagcatctcaaagcaaaacaatttttctttgtgcagatcaaaacggagtttcttttgtcttccttttccacatagacacagtaacagtctgagctctcttttccccacacaaaactatgtttaaaataatttaagtatgattatataagatttgggggccgggtgcagtggctcacgcctgtaatcctagcactttgggaggccgaggcaagtggattgcttgagctcaggagtttgagaccaacctgggcaacatggtgaaaccccgtctctactaaaatacaaaaaattagccgggcatgatggcacatgcctgtaatcccagctactggggaggatgagacaggagaatttcttgaacctgggaggcggaggttgcagtgagccgagatcatgccattgcactccagcctgggtgacacagcgagactccgtctcaaaaatttgggaccgttaataaacagttatatatatttgggagattagattacatgtattaaatcaagaacaataaaagctggtatttgataaagtactaaagtaaatataacatcctaaatgtttgcaatagaatgattatagaggatatgttgttggaaagtaccagaactagaaacccagtttctaagcaacctgtgaatctttggaaaattagaaaaaaaaatttggaagaatatttcaaatggctgaagatcaccgttccacttgctaaataggcatgttaagggcagaggccactcagattaatgaagtgttctattaacagttttaacgagaactcctgcagtactcttagaaacacccttaagagtcttgtctgtgttccctgttgtgattggcttggagtaggatacctgtctacctcatattacttatatttttccctgtcttcattttatctccctctggttgcatacttcatcactgaacacttaaggtaagatactaatctctgtgtatgtgcacttatttgttacaaagtatacttggcatatattttattttttagttgcaatgatagaaaagcatatatttaaatatcaaattataattggatagattatcagaattgaacattaaatctatttaccaagaaagtatgtttatttgtaaatgaaaataaaaatttgaatttcaaaggctaatcattccataaaagtttccatttctattcgtaatttaaattttattttgaaaaagtgatagtctaaggaactcatttaatttttggcctaaatgtgaaatatagaataaaaaacacacatatctattacagaaatacttgagatcctatatgtactatacaaatcctatatgtactgttatctacaaccatttgaacacttatccataaacccctaataagtaccttttgcttcaagacctatattccttagacccaccattagaaaattggatgttcactccagctatatgatatttaaaaaaaaaatgaatcagctgggagcagtggctcacacttgtaatcccagcattttgggaggcagaggatggcttgaggccaggaattcaagaccagcctgggcaacatagtaacaccttgtttctattaaaaaattagttttaaattttaaattacaataaaataaagtgtaagtattaaaaggccacttgtctatttctcacttggaatattaaatgctggaagctgtgtttgcctgtttatgaagatagaaacctaaatgcccttttgttctgtttatatgtttgaatgctcaatgttcatttccagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggaggtaaaaacaatattaactttggatttttaaaaattatcccaagagaaaattcttttaaaaagattctaagatctatctatatcttactacttatgtatatctatatcttacttatcaaaataatacttttggtacagaattcattttccatttcagtatctgttctgtcccatttttattgagaaagtccaaattctgtctaaaaaaactaaaattataatttataaattcttttttctttcacttatagattattgatgataccaactttacaagatgtaaatgattagtaatccaagacttaagcatgtgtgatgcccaaagagtcgcaaaattttgctttaacttttttcacttacattattctttaaatgtatactctactgttgtatgttaatcatattcccaatataattcccccccaccactgataatgacagactgccagtgaacttgctttgatttaaggcagtttcccaagataaattaggagggaagatagtcaaaaaaaggaaaacaaaaacgagtacaaaaatgaagccaggaatagttgttatccaaaactgtaaagtctgtcagaatactaacctttatttaacaacctctaggttctgttctaatggtaactatagaaccttcgcttgtttctcaaaatgtgatgttctggtagttcatttgtcatcctgataagattgaagttaagaaatagactcatttttgctttgttgtaactttcctcttataatctttttttttttccctaattgaatggtagctaataaacaatctgtattgtttggcctgtatttctttttcatcagtctgtcttccctaatatgacagggcagttaggaattttttctttttcttttttctttttgtagacataggatcttgctctgttgcccaggatgctcttgaactcctggcctcactcgatgctcctgcctcggccacccaaagtgttgggattacaggcatgagccaccatgcttggccagattttttctttgattgcttttctagaatctgttttcacttttgtgtttgtttctattttccttctatatgtgcaggatatattcagaaaaagtagaaattttatggcctggcacagtggctcatgcctgtaatctcaatactttaggaggccaaggtggacagatcacttgaggtcaggagttcaagaccagcctggccaacatggcaaaaccccatctctactaaaaatacaaaaattagctgagtgtggtggtgtgtgccagtaattcccgctattcaggagtctgagctacaagaatcacttgaacctgggaggcagaagttacgttgagccaagatcgcgccactgtacttcgacctgggcaacaacacgagactcagtctcaaaaaaaaaaaaaagaaagaaagaaattggcaaggtgcggtggctcatgcctgtaatcccggcactttgggaggctgaggcaggcagatcacgaggtcaggagttcaagaccagcctggccaacatggtgaaaccctgtctctactaaaaatagaaaaaatagctgggtgtggtggcgggcgcctgtaaccccagctactcgggaggctgaggcaggagaatggcgtgaacctgggaagcagaggttgcagtaagccgagattgcgccattgtactccagcctgggtgacagggtgagactccatctcaaaaaaaaaaaaaaaaaaagacattttgtaagaacttttgatccttaaaagtacataggctgatgcagtggctcatgcctataattccagcattttgggaggccaaggtgagcagatctcttaagcccaggagtttgagagccacctgggcaacaagccaaaaccccatttttacagaaaatacaaaaattagccaatcatggtggcatccacctgtagtcccagctactggggagtttgaggtgggaggattacttgagcctggagatcaaggctgagtgagccaagatcatgctgcataccactgcactccagtctgggcgacagggtaggtaaggctatcagagtgagactctgtctcaaaaaaaaaaaaaaaaaaaaaaactgttgaggctaggtgtgatggctcattgtaatcccagcactttgggggacccaaggcaggaagatcacatgagtccaggagttcgagaccagcctgggcaatatagcaagacctggtctctacatataaaagaaaaaaagagagagggaaatacattggtcttacattaataactttgagacacctatgcttttttacattgttactgaggtataactatctacagtaaagtatgctaatcttgagtgtacagcttgatgaatgttaacaatagttacacctatgtaactactatccagatcaaaatgtaaaatatttccaacatcccagaaggctcctttgcacaccttcccagtcagccttgatccattgcctgtttctgagatgcataaggtgaagtaatattgtatgtagtgttttgtgtctggctgctttgttcaacatattgtctgttaccttcactgaagttgttacatgtgattgcttactttttaaaaagtttaaatgtttgcatttcagttggtttttggaatcttctctcaaaaaagaaggtaatcctcaccctcacacaagtgcaggctgtttatcttcaacagttgaaaatcactgtagaggaagtatttatatatcttagtctacgttgtatcttgtgattatgtctaatgtctaattatattcattaataagaccatttcccccttcttttttattatacaagttgagattgggagtgtgttgagagccacataccacttttgatacgtggtagccaagtttttacctaatgttaaataatcttattccttgtctttattagttatgcagaaggggttaaaagataactttgctgatgtccaggtctctgtagttgattgccctgatttgactaaggaaccctttacctttcctgtaaaaggtaagcaatttttgcaattagcttttgttttttagtcataatctttttctgaaactagaattatttttaaggacatcttaaattatctacaaataaaggatattgtcacaacatttaggctaaattgtgccaaatttctgtgctcactcttctgatattggttaaatttcatttcatactcttgtggaaaaggattgtgttttattcacttatgtaaccttcacagattgtagaatagatatccaataggttagaattctttgtatcacacgagagttttgcttttaattgctcagactgttatggaaactgattttaatttttatgattttatttattcaagaccagaagggatcctaaaagccttgtatttgaatgatctgttaaaactaatccttcaacaaatttgccaagtgagcatccactgtttgaagtgagaaggaagggaaattagtattagaagaataaaataatttgtcagtatgatagatagttagttgatgtttcagtttttacaataacaccacaaggtaagtagtagcccttgtttatagatgagaaaactgaaaacgagagaggctagataagctcagtgtaaatcataaccaggattcaaatgcaagtctgtttccaaagtctaaccccctcctgttataccctattatgatgaggaatttgaggataaacactcaaagtgttctttttattatgtaattaacatctttgctaaaaaggagtttgccatagaaattctggactctagttctgtcttagaacaaacctgactttgagataacattagcatgaggggatttgaattgaatgttttttgggggcctttacagcttaaacaatctttgattttaagtagagctgtaaattctagaaggcttgtgtaccatgtggcaatttcttttagcttcttcaaaggatttagcatagtacttttttatagttttttttttttttttttttttttgagacagagtctcactctgtcaccaggctggagttcagtggcgcaatctcagctcactgcaacctctgcctcccaggttcaagcgattctccagcctcagcctcctgagtagctgagactacaggcatgtgccaccacgcctggctaattttttgtatttttagtagagacagggtttcaccgtgttagccaggatggtctcgatctcctgacctcgtgatccgcccacctcggccttccaaagtgctgagattacaggcgtgagccaccacgcccagccttgatttttttaaaaatatgagtgtaatgtatttcccctgctaattaagtaattaactaaaattaaataaaggtcaggagacagaagagtacaagaaagaaggaaaaatggttaatctttttttttttttttttttttttgtgtgtgtgtgtgtgagatggaatctcgctctgtcgcccagactggagtgtggagtacagtggcacaatcttggctcactgcaatctctgcctcccgggttcaggcgattctcatacctcaccctcccaagtagctaggattacaggtgtgcaccacgacacctggctaatttttgtatttttagtagagacggggtttcatcatgttggccaggctgatctcgaactcccagtctcaagtgatgtgcccgcctcggcctcccaaagtgctgggattacaggtgtgagccatcatgcccagccaaaatggttagtcttaattttgtcatgcagagttatgcttggaagaagtgttttctggtcagtaatttgtgagtctttaaattgcaatactagaagccagatatgcatctaatatgtgtatgtatgatctttcataaacataggagtttaagaccaaactggccaacatggtgaaacccaatctctactaaaagtacaaaaattagctggatgcagtggtgtgttagacattttctacatgaactggtcttgctaagatcaccagtgaccttaaaatgtttactagtactatttaacctctccacgtatttcatactgcttggccattgctgcctgacattctcccctaggttctatcttctctatccttgtttcacctgttcttcctttgtgcctttccttcctcttttcttccatattttcctggttcctttttctttctaatagtctcttaaatattgatcttttccagaattctttccttagcctcttcttatttctagtaatctatctgggtattttttaaatccactcttatggttttaattactacctgaatataactttgaaatttgtacatctcacctagatctctctgggttttttttttttttttttttgagacggagtctcgctctgtcacccaggctggagtgcagtggcgcgatctcggctcactgccagctctgcctcccaggttcacaccattctcctgcctcagcctcctgagtagtacacccagcctcctgagtagtacgcccggctaattttttgtatttttggtaaagatggggtttcaccgtgttagccaggatggtcgcgatctcctgacctcgtgatgttttgttttttgagacagagtcttgctctgttgcccaggctggaatacagtagcacaatcttggctcactgcaacctctgcccccgccgggttcaagcaatcctcctgccccagcctccttggtagctgggattataggctcccgccaccatgcccagctaatttttctatttttagtagagattcaccatgttggccaggctggtctcgaactcctgacttcaggtgatccacccgcctcagcctcccaaagtgctgggattgcaggcgtgagccaccatctgagaatttacattgtaccagagcaaaatattttaaattaaaaaacaagaaacaattttagccaaaaaaaggaaaaccaccccaaaatagattttttttaaagaaataaggcgtcaaagacattctagaaaccttacccaatccaaactttggccccagttctaacccttgcccttgccttgtattgcctttatgccaccaactttataagccatgcttggttatgatgattattagagacacaggtacttaaaataggacaggggttctagccactatgtcttccaatccctgttatttgtaaaactttatgataatggagaagttatatactgttggcattttattattaaattagatgtttgcctgtttttaaggtggcttgtgtttttgttttttggttttttcttaggcatctgtgggaaaactagaattgcagaagttggaggtgtgccttacttattgcctcttgtaaaccaaaaaaaagtaagtacttttactctgcatattcacatgaagattgtagaagttgggttgattactgtgtttattattagaagacctgttgatcagttggcaaggaagtgctaatggatcagtaataaaaggtaaaccagggactttgtacaagttgtgacttaaataatattttttcctcttctataggtttatgatctgaataaaattgcaaaagaaatcaagctgcctggagcctttattcttggagcaggagcaggtccatttcagactctcgggttcaattctgaggtcagcatatataagaaaattattttactttattggtttgacatttggtttgtctttttgcttttagtgccaaaaatcctactttctgagtgaattgtaaatctctctgcaggtttgatactacttgatgtagatttctgctatagcacacactccaactggactaactgtaatggagtactaacttgtagttttagattttcttaggtcatagcttcagccttagataaatgcagggttctatggtattctgttgaaggttctggattataaaatatttatattcttacaggattccgagcttatctataaatctttgctttgggtatgcaggcagctttggattagaagatgaatggaatattagtgatctagtcaactccttcttccacaccaaatagtaggaaactatcacaatagtatgatggttatttatgaaagttaatagttattactagtatatattattaccatatgaaaatattactgtttctttgaatctcatgaatacaagacttcagtctgctcattctctcataacctcttcagatatgaatagtagtcatacaagttctttgcagaaacattagtacaatttgcctagtgttcaagttaggaaaaaaagttaaaaatttaaaataagatatttaacgcaagttatagatacactgtaagaaatccaataaatatcttttttttttttttttttttttttgagatggagtctcgctctgtcgccatgctggagtgcagtggcgcgatcttggctcactgcaacctccacctcccaggttcaagcaattctcttgcctcagcctcttgagtagctgggactacaggtgtgtgccaccacgcccagctaatttttgtatttttagtagagacaggttttcaccatgttggccaggatggtcttgatctcttctcttgacctcgtgatccgccccccttggcctcccaaagtgctgggattacaggcatgagccacagcgcccggcctataaatgttttccaagttttttatgtctaaaattaaatattatgtattttatgttctcttattaggacttgaactaaaatgtcttaaaaggattaaatgttttgtaacattattcaagatattctctttgcagagatacaaagattgactaattgcctcactttcttttcagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtgattgtgtccataaaaatacaatattccctaaatgttctcagaaagctaaaaatgtgaacttttactgccataaatatggttttgctaagaaaattagtttcccactttgggaggccaagctgggtggataacttgaggtcaacttgaggtcaggagttcaagaccagcctggtcaacatggtgaaaccccatctgtaccaaaaaatacaaaaattagcagggtgtggtggtgtgtgcctgtaatcccagctactcgggggggctgaggtgagagaatcgctcagactcggaaggcagaggttgcagtgagccaagatcatgctactaccctccagtctgggccactgagtgagactctgtctcaaaaaaaaaaaaaaaaagaaaattagagcttcctaagtcaaagctctttaaataacccagtaatgaaaggttcagagagtatgacaggcagagcaaaagtcatctttaaggttaagaataatatggctggaggccagacgcggtggctcacgcctgtattcccaagcattttgggaggccaaggtgggtagatcacctgaggtcaagcatttgagaccagtctggccaacatagcgaaacctcgtctctactaaaaatacaaaaattagacagggaaggtggcacatgcctgtagtcccagctacttgggaggctgaggcaggagaattgcttgaacctgggagacagaggttgcagtgagccaagattgcaccattgcactccagcctgggcaacaaagcaagactctgtctccaaaaaaaaaaaaaaaaaaaaaaagaatagtatggctggcacaatggcttatgcctataattccagtcctttgagaggccaaagctggaggatcacttaaggctggcagtttcagaccagcctgggcaacatggcaagaccctgtcaaaaaaaaaaaaaaaaaatttttttttttaattagccaggtgtggtggtacatgcctatagtcctagctactcaggaggctgatgcaggaggatcccttgtgcccaggtgtttgaggccgcaacgagctatgatcacaccactgcactcctacctaggtgacagcaagacctgtcttaaaaaaaaaaaaaaaagactacttagtaagcaagacctttttctgagaactaaaaggtaatagaatattaatttggggagtgagtttgtcatctacatgaaccatacagctaaaataaataatgcctacttacaggtagtaaataggttatttgcttctttctgatgaatcacacattgctctagatagaaatggtggtagcaaaaacttacagcaagaacaaagtaaggaaaactaatgccttacttgatatttacttcctattagtacacaaaaatatgatttcagtgttagcttttgtgaagactctccagttttggaagtagagatagcctcttcagctactttgagataagagattgagaagtgaaaatacttaacgtccaagttgtggagataatacagaattttaagggaagtgagaaaatgtaatcattttctcctcatccccacttaccaaaggttaattcctttaaccaaagaattaccaaaggtaattctcaatctttgactgcctcgacacgtatgttaagagtctctagactctctgcactgagaaacttgtctttctcagtttctcagttcaagaaagcatgcttaagacttactagtaaattacatgtaactgataagtatgtgtgtgtgtgtgtgcatacatatatatatgactgatcaaaattcacgggattgcaacatctcaactcagatctgggggctctaagcaaagaacagaatatttgcttgatagaattaaattatataatgttttatttcagtagttattttgcagcatagtcaatggtatgcatctttatgtcctctataggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatggtaagagcccatgtgtgcatacatgcatgaaggagtttgtgtgtgtgcacttacttaagatcttaggatttttttttttttttaaacggatccttgctctgttgcccatgctggagtgtagtggcacaatcttggctcactgcaacctccatctcccggattcaaggggttctcctgcctcagcctactgagtagctgggattataggcatgcagcatcacaaccggctcattttgtagttttagtagagacaaggttttgccacattggccagactggtgtcgaactcctgacctcagctgatccacctgtctcggcctcccaaagtgctgagattacagacgtgagacgctgcaccgggccagatcttaggattgtaaagtatgtgttgggaattctacatttgaagacactttaaacaaatcctttttattatgattgtattactttaaaatttaaatgataattttataaatcagattgtaagataatatctttgtccatgttagtatattagaactttattttggatatgtttgtttttaagatcaagataaattcaaggcctgcagagtgactcatgcctgtaatcccagcactttgggaggcccaggtgggaggaccgctggaggccaggaattcaaaaccagcctggtcaacatagtgatgatggcagcggcaggctctctggagcggctgcagcagggaggcacggctgaggctacacactctatggagcgggtgggagctgaagacaggtgggagtcctgccccttccgagttggcgctggagctccgttggtgccgctgcaatcgcccaagccatggctgtagtccctggcatccctgtgctctcccagtgggaacaggcgagagccccaactgcccaggcgcagctgcagcagctcaaacccgcggctgcagacctgggtctcccgctccacggagcaggcaggagccctgccttctccacacagctgcagctgcccaaaccgtggctgcggacccaggcattcctgcattcttgggggtctgggaaggcccccactgctcttacaggcttggaaatgcctgctcccactgcctggcttctccctgctgtcggcgcctgctccgatccaggagcaaagtcaggcagagcccggtcgctgtcgcagcccagccaggtgtgcacacgctcagggcactgctgacacaccagccccctgccgtcccggccccttctggatttggggcgctgacacgagcgtagaagggaagctgagcggcggctgagagcagctccccactggccttcaggcaccccttggcacctacagcctggattccgtgatcggcagcaggaggcagacaggttccggggcagaagggggcgggtttccggtgaggccccactttcgggccagggaaggcctgaaggctgggggcccagctgccaatcccacacaccagagtggaaacttgtggtgctttttccaggcccactgtgatcatcccactgcactccagcctgggtgacagagccagaccctgtcaggaaacaacagatgctggagaggttgtggaaaaataggaatgcttttacactgttggtgggagtgtaaattagttcaaccattgtggaagtcagtgtggtgattcctcaaggatctagaactggaaataccatttgacccggcaatcccattactgggcatatacccaaaggattataaatcattctgtgataaagatacacgcacacatatgtttattgcagcactattcacaatagcaaagacttggaaccaactcaaatgactggattaagaaaatgtggtacatatacaccatggaatactatgcagccataaaaaaggatgaatttatgtccttttcagggacatggatgaagctggaaaccatcattctcagcaaactatcacaagatcagaaaaccaaacaccccatgttctcactcataagtgggttgttgaacaatgggaacacatggacacagggaggggaacatcacacaccggggcctttcggggagtgggggactaggggagggatagcattaggagaaatacctaatgtaggtgacaggttgatgggtgcagcaaaccaccagggtacgtgtatacctatataacaaaactgcatgttctacacatgtaacccagaacttcaagtataattaaacaataataataaataagtaaaatatatttttaaaatttttaattcttagtaatattcagtatgtttacctatgtaattatcttttgttgtagcctgcagaattttcttcctgccccttgaactctgatgaagaagtgaataaatggttgcatttttatgaaatgaaagctcctttggtttgtctaccagtttttgtctccagagacccagtaagtctgtgtctgttttttatattatactacaatgataatgcttgatttttaggataatctttaagaactaggcacttttgtgtttgttgttgttgttgttttgagacagagtttcactcttgttgcccaggctagagtgcaatggcaggatctcagcttactgcaacctccgcctcctgggttcaagcgattctcctgcctcagcctcccgggtagctgggattataggcatctgccaccatgcctggctaatttttgtatatttagtagacggggtttcaccacgttggtcaggctggtctcaaaccactgacctcaggtgatccacccacctctgcctcccaaagtgttgggattacaagcatgagccaccatgcccggccatgtgttgttgttatttaagaatgagggtagcctctagaattattttggaagataagggagctcttcaccatcctatgagttaggcagagcagattttacctttgagaaaatgaaggcacaagcattttaaataacacccaaaattattttattaaatagcaggtgtagttgggcatggtcacatgccccagtattcttagctactgaggaggctgacttgaacccagaagtttgagaccagcctgggtaacagtataatccccatctcaaaaaaaacaattagtagagtcacaactaggattcaggtctcctgtcatcttgtttggtgttcattatattataatactatacgctagaaaaaatattacagaccaattcaaagcaaatacctactaaaatattggtcatatcttctcttttttttattttttgtgacagagtctcgctctgttgcccaggctggagtgcagtgatgcaatctcggctcactgcaacctccgcctcttgggttcatgtggttctcctgcctcaccctcctgagtagctgggattaccggtactcaccaccacacccggctaatttttgtattttcagtagagacagggtttcgccatgttgaccaggctggtctcgagctcctgacctcaagtgatccgcccgcctcagcctcccaaagtggtgggattacaggcatgagctactccgcctaccctggtcatatcttgatccagtgattacatgcctaggatattatacttaaatatatgcataattgtgtaaaattactagttaaaaggttattattacagtattgttgtagtagcaaaagaattagaaataatgcaagtgtcagttgagaagttacatacgcaatagaataccatgcaggtataaaagaatgaggaagctcttttatgatttcatatacaaagatctcaaaactatattgttacatgaaaaaaagttacatgcagaaaagtgtgtacaaaatactacatttgagtaaaaataaaagtaagtatttatggaaggatatacaagaaaatgcttacactggttacctgctaggaaggggagtgagtggtgagggcaagagagaagaagatacattttactgaatacatcgttttgccccctttgaatttagaacatgtgaatgtattacctatttaaaaaataaaaactattgcaacgtaaaaagttatccctcccccttaaactctaatcaataatttgagtactaacatattgtttgtctgttatcttaggggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaattta

SEQ ID NO: 508 - DNA, 41762 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtca

SEQ ID NO: 509 - DNA, 47861 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtcacttgagaagaaagggagaagttcctatgaggctgtcggaaagggaaatggggccctccgcttgttgaaaacaaaacaaaaccctcaggaagctttgcatcctgttagtcatagcttaaatttatgacttcaatgacttggctgggacagtcttaatctctccatactcaagttgttttaatttctgtaataataatttttataccaatgtttgtgttgttaatactaataattttacattgtaactgtaatcctttaattattacaagtgttaacctaaataacaaacatatgaaagcttcctaaaggaaacagtgtttatttgggaatagagcattgcaattgggaatagatatgccatattaaactatgtatatattcaggaagataaaggaagacagaaatggggaggattgcatattgttttgacaggattttccttggccacaggatcaggcacaaaggtgacattagtctgaggttggacaggcagttgctgggcagcattccttgcagaaatattttttgtttaaggttgcaatgacctttatgcaaggttgtgggttttgtagagtctttttcattttcaagcatacaaggataagaccccccctcttcatggctttcctggctttatttgtcagggtcatcttaacattagtggctccattttgttctgacaactttcagatttctccttgtgatcaagaactttctctaaaagcattattgatcaatcattctgtaattaagatttgatgtcccctgatgccagcatggacctctcccagtttgctggtctcatcccatgttgtggggagtgactggtgactaggaatcgatgtcaaaagcacatttgagcaacaaaagagatttgaaggatgtggctctcaggctaagtctccctggagtccattagtaagttcaattttgtctgttctacagtcttttgctatccctttaaagtgctgattcagtattattttgttaggagctgcacctctgaaaaaatttaacaagtaacacatacaaagtttaaaaaggagaaatacaaagtaaggggaaatacaaattaagagcaatatgagattttcagtttgcatatggttttgagccataaacctaggtttaaagacaactaattgaagaactcaaacagttattcgagacagcagggagttaggtgagacctggggtaaccacatggcctgctttcttattttgtgtataggagcctcaacttttctcagaggaatttattcaggtatagcatgtcgtattagcaacatcacagacaatttcttgcttaaccaatggatactaaagaattttgtaggttgggttctgttaagttataagcagaaggaattgatcataaaatttaagttacaccattattctgctaagtagaaaaggtcgaattaagtgagatgaaagtctcattatgatatagagtcttgtttcagcatcttgcagaaagttatacagtgtgaaaacaccaactttttctcctggtttgtagtgtgaacgtctctggttatgatattgggcagtttggtaaactattgtgtgatccgcatatcagccttgaggtttgttccctctttcattttcctctggatcaccaacatgctaatctacgttcacatcactgaaaccgtagaggccaataccaatttcaccatttctggtcctggatatttgcaagactgttgtcaaactaggccatacatacaataatttaatatacatttggggcttggattatatttctgttaaattgcactgctctatgggacttattttattcattccacaaatatattttgcacatgttccttattcttggtactatttaatggatttggcatacatccgtgatctaaacagataaaactcccccaaggatcatttataaatgtcatggtgattcgccatgtcctgtttgtgttcctcatggtctggaccagcatcaacatggccagtctcctctgcagacaccggcggagagcccagcgtctgcacagccctagcctctcttcccagccatctcctgaacacagagccacccataccatcctcctgctgcttggttgctttgtgtgcttttattgctcaaacaacttcatcactctttatttcttttataaatctgagaaaaaatcaagactagagatgatcactggaattatttcatcatgctacccaaccatctgcccttttgtgctaataaaaaataataaaattatttcctaatttacctcttcctctctaagacaagaatgatcagctctcagggagcattcaatggctgatctcaaaccccatactttcttctgcagctgggaagtctccatgatgacttttgtggagaaaaagtcatgcagttattgagcaattgaattagggctagtttgaattgaggtgtatcataaatttaaaaagcattcaggttttgaagtcaatataaataacagtatataaatattatcttaataactttcacattgctgacaagtttaaattatgacattttgggtaaaacgtatgtatatgttttgttatgtttacatatatatgcatatttaaataaaatacatatacacaaatatgtaagtaaaacatatgtaagaatatatataatatatataattttttttttttgagacagagtcttgctctgtcacccaggctggagtatgcagtggtgtgatctcagctcactgcggcccccacctcctggattcaagcaatcctcccacttcagccttccgagtagctaggattataggtgtgcaccaccatgcctggctaatttttttgtattttttagtagagacagagtttccccacgttggccaggctggtctagaactcctgacctcaagtgaaccgcctgtgtcagcctccaaaagtgctaggattgtaggtgtgagccaccgcactggccttatcagtatatacacacacacacacacacacacacacacatatgtgtatacatatacaactacataggtatttttaaactaactgtatctgcttgtttttgcttttttaaatgcagttgctagaaaatttaatatacatttggggcttggattatatttctgttaaactgcactgctctatggcacttcttgtattcattccacaaatacattttgcacatgttccttattcttggtactatttaatgggttggacatacatccatgatctaaacagataaaacataatagcacaagagattatacagaatgtttgtggtacaggaaaacgtatatgtacacatgataggagctaaaaagaataggactggttaagagaatgtggtgtgtgagagtacaggtgcagggagctgcagtgactgggattacaggtatgcatcaccatgcctggctaatttttgtatttttgtagagacggggtttcaccaatttggccaggctggtctcgaactcctggcctcacgtgatccacctgcctcagcctcccaaagtgctgtaattacaggtgtgagccaccgtgcctggccaacatttatcattttaaatactcatctgcaaaaatgtttccaagtggggccacttccccacccctcatatgacagtggcagtgatataccatatacatggttattaaaaagaatctggagcaacaatatgaatgtcagacaaattaggcttcaagagcatttccctccatcttacaggggataaacccaaagaagttatattaagattccaataaaagaatgcaagatgactatctgtgtaaaaatgtaatcaatggggagcaggtgcacctccaataatattagacaaaatatattttacctaaacagcattactaagtataaagtagatcacttcaataagaataacaattttaattttgtgtatacatattcacactttcaatatgtatatagtatacacgggtagaatgataaacagatatagaataatcctccactcttgtgggaaatctgttcaatagtctttcagcaattaacagaataacagagtatcagtaaagatataaaaaattgaccaaagcaattcatattcttgacttaagtgccctagaataacaactcacacagccattgaagaatccccatcatcctatctcaagcatagaggaaacacatagcatacatatgtagccacatagcaaacacagaaatgactatcaacaaagtggaagagtttaatgcacagattaagttatctgaatatatgtacaatgagttataaataataaataattgagccaggtgaagtagtacatgcctgtaatcccacctacttgggaggctgaggtaggagtttgagcccaggagtttgagtctggtctgggcagcattgcaagatcccatcccccaaataataaataaactaactaagtaatcaataattgaatgagaaaagttagctcatatttcaatatgttcaatcttaggatatatacttctaggcaaccacttagtgacaaaaattctgtagaaatccatcattgaaagttcattatgtaaataaatgtgaagactagataagaaccacagaacacaatgacattggaaaaaatgccacagtaattctttgaaaaaagaaatgcaggcctggtgcggtggctcatccctgtaatcccagcactttgggaggccgaagtgggcagatcacaagtcaggggttcgagaccagcctggccaacatagtgaaaccccgtctctactaaaaacacaaaaacaattagctgggtgtggtggtgggcacctgtagtcgcagctactcgggaggctgaggcaggagagtgctttcagagaaacttcttgatcacaaggggaaatctgaaagttgtcagaacaaaatggagtcacttatgttaagataaccctgacaaatagagccaggaaggccatgaagagagggctcttatccttgcatgcctgaagatgaaaaagactctacaaaacccacaaccttacataaaggtcttcacaaccttaaaaaaatatatatttctgcaaggaatgctgcccagcaactgctggtccaacctaggactaatgtcacccttgttactgatctttgtagccaaggaaaattctgttaaaacaatatgcaatcctccccatttctgtcttcctttatctccctgaatatacacatagtttaatacggcatgtctattcccaattgcaatgctctattcccaaataaacattgtttccggctgggcgcagtggctcacgcctgtaatcccaacactttgggaggccaaggcgggctgatctcgaggtcaagagacggagaccatcctggccaacatggtgaaaccccgtctctactaaaaaataaaaaattagctggatgtggtggtgcacgcctgtagtcccagctacttgggagactgaggcacgagaatcgcttgaacctgggaggcagaggttgcagtgagccaagatcatgccactgtactccagcctagccacagagcgagactccatctcaaaaagaaaaaaaaattgtttcccttaggaagctttcatatgtttgttagttaggttaacacttctaataattaaagttatacagttacagtgtaaaattattagtattaacaacataaacattggtataaaaattattattacagaaattaaaacaaattgagtgtgagagagattattaagactgtccaagccaagtcactgaagtcataaatttaagttatgacaggatgccgagcttccagagggttttgtttttaacaagggaggggccctatttccccttctgacacgctcatatgaacttctcactttgtcgtactccttccttgctgactaagaggaacagaacacagagcagcctggcggtgtcctaccaacaagcctccgtttctccttcctgtacactagggctcctgaaactcacctggtaagcgctccagaaaagcagcaggtggtgactttagggtaggacgggccaaatgggagaatccccttaggtcggtttctctggttctcaacttcttttgaaataacgctcgcagaggaggtgggctttctgagaactgagggaagtaagct

SEQ ID NO: 510 - DNA, 41762 bp, Homo sapiens; identical to SEQ ID NO: 508

SEQ ID NO: 511 - DNA, 41762 bp, Homo sapiens; identical to SEQ ID NO: 508

SEQ ID NO: 512 - DNA, 41548 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttct

SEQ ID NO: 513 - DNA, 41548 bp, Homo sapiens; identical to SEQ ID NO: 512

SEQ ID NO: 514 - DNA, 17686 bp, Homo sapiens
taacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtcacttgagaagaaagggagaagttcctatgaggctgtcggaaagggaaatggggccctccgcttgttgaaaacaaaacaaaaccctcaggaagctttgcatcctgttagtcatagcttaaatttatgacttcaatgacttggctgggacagtcttaatctctccatactcaagttgttttaatttctgtaataataatttttataccaatgtttgtgttgttaatactaataattttacattgtaactgtaatcctttaattattacaagtgttaacctaaataacaaacatatgaaagcttcctaaaggaaacagtgtttatttgggaatagagcattgcaattgggaatagatatgccatattaaactatgtatatattcaggaagataaaggaagacagaaatggggaggattgcatattgttttgacaggattttccttggccacaggatcaggcacaaaggtgacattagtctgaggttggacaggcagttgctgggcagcattccttgcagaaatattttttgtttaaggttgcaatgacctttatgcaaggttgtgggttttgtagagtctttttcattttcaagcatacaaggataagaccccccctcttcatggctttcctggctttatttgtcagggtcatcttaacattagtggctccattttgttctgacaactttcagatttctccttgtgatcaagaactttctctaaaagcattattgatcaatcattctgtaattaagatttgatgtcccctgatgccagcatggacctctcccagtttgctggtctcatcccatgttgtggggagtgactggtgactaggaatcgatgtcaaaagcacatttgagcaacaaaagagatttgaaggatgtggctctcaggctaagtctccctggagtccattagtaagttcaattttgtctgttctacagtcttttgctatccctttaaagtgctgattcagtattattttgttaggagctgcacctctgaaaaaatttaacaagtaacacatacaaagtttaaaaaggagaaatacaaagtaaggggaaatacaaattaagagcaatatgagattttcagtttgcatatggttttgagccataaacctaggtttaaagacaactaattgaagaactcaaacagttattcgagacagcagggagttaggtgagacctggggtaaccacatggcctgctttcttattttgtgtataggagcctcaacttttctcagaggaatttattcaggtatagcatgtcgtattagcaacatcacagacaatttcttgcttaaccaatggatactaaagaattttgtaggttgggttctgttaagttataagcagaaggaattgatcataaaatttaagttacaccattattctgctaagtagaaaaggtcgaattaagtgagatgaaagtctcattatgatatagagtcttgtttcagcatcttgcagaaagttatacagtgtgaaaacaccaactttttctcctggtttgtagtgtgaacgtctctggttatgatattgggcagtttggtaaactattgtgtgatccgcatatcagccttgaggtttgttccctctttcattttcctctggatcaccaacatgctaatctacgttcacatcactgaaaccgtagaggccaataccaatttcaccatttctggtcctggatatttgcaagactgttgtcaaactaggccatacatacaataatttaatatacatttggggcttggattatatttctgttaaattgcactgctctatgggacttattttattcattccacaaatatattttgcacatgttccttattcttggtactatttaatggatttggcatacatccgtgatctaaacagataaaactcccccaaggatcatttataaatgtcatggtgattcgccatgtcctgtttgtgttcctcatggtctggaccagcatcaacatggccagtctcctctgcagacaccggcggagagcccagcgtctgcacagccctagcctctcttcccagccatctcctgaacacagagccacccataccatcctcctgctgcttggttgctttgtgtgcttttattgctcaaacaacttcatcactctttatttcttttataaatctgagaaaaaatcaagactagagatgatcactggaattatttcatcatgctacccaaccatctgcccttttgtgctaataaaaaataataaaattatttcctaatttacctcttcctctctaagacaagaatgatcagctctcagggagcattcaatggctgatctcaaaccccatactttcttctgcagctgggaagtctccatgatgacttttgtggagaaaaagtcatgcagttattgagcaattgaattagggctagtttgaattgaggtgtatcataaatttaaaaagcattcaggttttgaagtcaatataaataacagtatataaatattatcttaataactttcacattgctgacaagtttaaattatgacattttgggtaaaacgtatgtatatgttttgttatgtttacatatatatgcatatttaaataaaatacatatacacaaatatgtaagtaaaacatatgtaagaatatatataatatatataattttttttttttgagacagagtcttgctctgtcacccaggctggagtatgcagtggtgtgatctcagctcactgcggcccccacctcctggattcaagcaatcctcccacttcagccttccgagtagctaggattataggtgtgcaccaccatgcctggctaatttttttgtattttttagtagagacagagtttccccacgttggccaggctggtctagaactcctgacctcaagtgaaccgcctgtgtcagcctccaaaagtgctaggattgtaggtgtgagccaccgcactggccttatcagtatatacacacacacacacacacacacacacacatatgtgtatacatatacaactacataggtatttttaaactaactgtatctgcttgtttttgcttttttaaatgcagttgctagaaaatttaatatacatttggggcttggattatatttctgttaaactgcactgctctatggcacttcttgtattcattccacaaatacattttgcacatgttccttattcttggtactatttaatgggttggacatacatccatgatctaaacagataaaacataatagcacaagagattatacagaatgtttgtggtacaggaaaacgtatatgtacacatgataggagctaaaaagaataggactggttaagagaatgtggtgtgtgagagtacaggtgcagggagctgcagtgactgggattacaggtatgcatcaccatgcctggctaatttttgtatttttgtagagacggggtttcaccaatttggccaggctggtctcgaactcctggcctcacgtgatccacctgcctcagcctcccaaagtgctgtaattacaggtgtgagccaccgtgcctggccaacatttatcattttaaatactcatctgcaaaaatgtttccaagtggggccacttccccacccctcatatgacagtggcagtgatataccatatacatggttattaaaaagaatctggagcaacaatatgaatgtcagacaaattaggcttcaagagcatttccctccatcttacaggggataaacccaaagaagttatattaagattccaataaaagaatgcaagatgactatctgtgtaaaaatgtaatcaatggggagcaggtgcacctccaataatattagacaaaatatattttacctaaacagcattactaagtataaagtagatcacttcaataagaataacaattttaattttgtgtatacatattcacactttcaatatgtatatagtatacacgggtagaatgataaacagatatagaataatcctccactcttgtgggaaatctgttcaatagtctttcagcaattaacagaataacagagtatcagtaaagatataaaaaattgaccaaagcaattcatattcttgacttaagtgccctagaataacaactcacacagccattgaagaatccccatcatcctatctcaagcatagaggaaacacatagcatacatatgtagccacatagcaaacacagaaatgactatcaacaaagtggaagagtttaatgcacagattaagttatctgaatatatgtacaatgagttataaataataaataattgagccaggtgaagtagtacatgcctgtaatcccacctacttgggaggctgaggtaggagtttgagcccaggagtttgagtctggtctgggcagcattgcaagatcccatcccccaaataataaataaactaactaagtaatcaataattgaatgagaaaagttagctcatatttcaatatgttcaatcttaggatatatacttctaggcaaccacttagtgacaaaaattctgtagaaatccatcattgaaagttcattatgtaaataaatgtgaagactagataagaaccacagaacacaatgacattggaaaaaatgccacagtaattctttgaaaaaagaaatgcaggcctggtgcggtggctcatccctgtaatcccagcactttgggaggccgaagtgggcagatcacaagtcaggggttcgagaccagcctggccaacatagtgaaaccccgtctctactaaaaacacaaaaacaattagctgggtgtggtggtgggcacctgtagtcgcagctactcgggaggctgaggcaggagagtgctttcagagaaacttcttgatcacaaggggaaatctgaaagttgtcagaacaaaatggagtcacttatgttaagataaccctgacaaatagagccaggaaggccatgaagagagggctcttatccttgcatgcctgaagatgaaaaagactctacaaaacccacaaccttacataaaggtcttcacaaccttaaaaaaatatatatttctgcaaggaatgctgcccagcaactgctggtccaacctaggactaatgtcacccttgttactgatctttgtagccaaggaaaattctgttaaaacaatatgcaatcctccccatttctgtcttcctttatctccctgaatatacacatagtttaatacggcatgtctattcccaattgcaatgctctattcccaaataaacattgtttccggctgggcgcagtggctcacgcctgtaatcccaacactttgggaggccaaggcgggctgatctcgaggtcaagagacggagaccatcctggccaacatggtgaaaccccgtctctactaaaaaataaaaaattagctggatgtggtggtgcacgcctgtagtcccagctacttgggagactgaggcacgagaatcgcttgaacctgggaggcagaggttgcagtgagccaagatcatgccactgtactccagcctagccacagagcgagactccatctcaaaaagaaaaaaaaattgtttcccttaggaagctttcatatgtttgttagttaggttaacacttctaataattaaagttatacagttacagtgtaaaattattagtattaacaacataaacattggtataaaaattattattacagaaattaaaacaaattgagtgtgagagagattattaagactgtccaagccaagtcactgaagtcataaatttaagttatgacaggatgccgagcttccagagggttttgtttttaacaagggaggggccctatttccccttctgacacgctcatatgaacttctcactttgtcgtactccttccttgctgactaagaggaacagaacacagagcagcctggcggtgtcctaccaacaagcctccgtttctccttcctgtacactagggctcctgaaactcacctggtaagcgctccagaaaagcagcaggtggtgactttagggtaggacgggccaaatgggagaatccccttaggtcggtttctctggttctcaacttcttttgaaataacgctcgcagaggaggtgggctttctgagaactgagggaagtaagct

SEQ ID NO: 515 - DNA, 32978 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttacc

SEQ ID NO: 516 - DNA, 32978 bp, Homo sapiens; identical to SEQ ID NO: 515

SEQ ID NO: 517 - DNA, 1586 bp, Homo sapiens
gtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgccttcccattaaatgcaggtagttgttccccttcaagcactagtcactggccataatttaaatcttgctatcttcttgccaccatgaaccctgtatgttgtaggctgaagacgttaaaagaaacacacgctgacacacacacacacacgcgcgcgcgcacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaacgaccatacttgtcctgcctccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgt

SEQ ID NO: 518 - DNA, 57069 bp, Homo sapiens
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaaggtacgcgggaccgggcctcagggtgggggccgagccgggcgccgctcggggctgctccccgctccggcccgcggcctcctcgttccctcccctccctccgtcgagctccgggaggcctctcgcctcccttctccgggccccggcgtcgcgggccggaccgcggcctccccgcggctccctggtttccgccccccggaatgtccgcgcctgaagcccggggaactacgggactgagtgcgcggcgggcggccctgaagtccgagaacgggccggagaacacggagaaacgcgtcttccaactccgaaattcggggcttctgccgtcttagcacaaaacaaagccggagtattcaaagaatttttccgcccagcttgagttcatcgcggatgcgttgactacacagcacccattttctcactttgttcatttcaattcgtggcgatcttcctctggtgaactcttgagtaatgtgctaaaactttgggtttgctctgcgacgcagacattctcgaaatgccatcgatgccgtggagcagatcccatctccctcggctcatcctctgttggtatttacctgttaaaccggaatcctcaaagcctgttgtgcaaccacctcattagggcgcgtggtaaaaatgcttgctgctgccccgacgcccctgtttctggaaacgggttcaagcttgatccaggatccttcttgaccaggcaagcttgacctttgatccaggctcagtgggcgttgactgatccctctggaggctctctgggaaagggaattcggccgagaaggaaggtgcccctacccacagtgttaatatttggcatccctagagtctgtgtgggttttgtttccgttcacacgtgcagggcctttgctccgccaggaaaccagaaagaaaataaactttagctcctgaatcttaaaggaaatctcacaacagtgtaaaatactttgagggaagctagataacctaggtgattttcccagcacttctggtagaggtgggaactgcatagcatggttagggaccctgtggataggttaggtccaaggataaagaagaagattttcgaaatctgtaaaattttaaaaatcgttaacagataggggagtggtttcacgggatcaagtatttaataatatttcttggatgctctggtaaatcctttatttatttatttatttatttatttttctaagatggagtttagctctttttgctcaggctggagtgcaaaggcaatgatttcggctcactgcaacgtccgcctcccgggttcaagtgattctcctgcctcagcctcccaagtagctgggattataggcgcctgccaccacccctagctaatttggtatttttagtagagacggggtttcaccatgttggccaggctggtctcgaactcctgacctcaggtgatccacccgcctcggccacccaaagtgctgggattacaggcatgagccaccgcgcccagcctctggtaaatctttttaatagccctggtgttgggacaaatcttatacctgggtagggaaccttttgatgttacagaactgtacaccataaaggagtagtatgagatggtgatagttgcacaactctgcaaatttgctgaagatcattgaattatacactttttaaaatcaccaagtctaattttaaaagtagtatgaaaaaccagggagtacccccacatttccctcttcaccttgtgaaacattatgcagtgacacattacctcattaaaacacctgtagacttggcggttagaaatcggctataggatgtatgatggatggtatttggtgtttattaaagactttcccagtgatgcttcttaagtaacttagtttttgcttggccttattttgaatttatttttatattttttatacaatagttacttagctgtatagtgtttttctggctttttgaaattatgaaaaagcctctctttatgaaattatgaaaagtgctgggtgagagccagatatgggttgaaaataatttctcattaaagtggtttaataaatttgttttaaagtattgctttacctaatctgaatttaaaagtgtcttgccagcttagtgactcaataagttggctgtgttacctttattcctcacaaagaaaaaaaatacatttgaaaattttaaagtatttttgttcttttttaaaaactacgaacatatccttttatgcaggaaccccaaaagtctacattttaacaacccacattttaaaaaacttttcagcagcttttagagtcagtatttcattagtctgtaatagttaaattcatatgacataatgacataaaatataaatttgttctttgtgtcatgacttgataaatatatgaatatagcagtgaaaaatttttttaatcattgaatttatgtttgtactcatggctttgatatttcatcccacatcattatatgctttttctttttcttttttttttttctttttgagatggcgtctcactctgttgcccaggccggagtgcagtggcacaatcctggctccctgtaacctctgccttccaagttcaagcaattctcctgcctcagcctcctgagtagctgggattactggcgcgtgccaccacgcttggctaatttttgtattttttagttgagacaggctttcaccatattggccaggctggtcttgaactcctgacctcaagtgatccacctgcctcagcctcccagaatgccgggattacaggcatgagccaccgcacccggctgctttttcttaagcaacatgagttaaatgtgtaaccagtttggggaatttgattatgttcgcaaaaactgacattatcaaacctttatatattagtctacatgatattatctaatcgaaaactacattataactgtctagtcaatactggacacatttcagatttcaagattagaagcaaggagttcaatcttaaaattttaaaatttacatgacttgttgagtaattcgatatcagaaaatttcaccttccatttcaaaatttgaacgaagaatggtagtctaaaagattaaagccaaaagtgtttgttttgttttgttttcgtttttttttgttgttgttttgagacagagtcttgctcttgcccaggctggagtgcagtggtgcgatcttggctcgctgcagcctccacctcccgggttcaagcagttctgccacagccttccgagtagctgggactacaggcgcccaacacagctggctaatttttgtattttgagtagagacggggtttcaccatgttggccaggctggtctcaaactcctgacctcagatgatccacccaccttggcctcccaaagtgctgggattacaggtgtgaggcactgcacccggcctgaagccaaaagtttattcatggaatttataatacagtgtgtatttggatgtagagatccctgttactgtttttaaactatggattaagagttaatctctttgagtaacagtcttagcattctcttttgaacttttttttttttaatttctcagggagagtgttattgggaaacctaactacacaggctgaaaagatacataagataaaaatgaaatatttttaaacaaacatctttgtaaccaccacccagggcaagacagacattgccagcatcccagaagcctcccaccacctatattttcccatcacaactatcaccatcttaatttaagctagatataaatgttcttctgacatttatagttttaccatataagtttacatctctaaataatagagtttaattttgcccatttttaactttatgtaaataggattgtgttgtatatattttatttttagcttttattgtttcataatattccatcatgaatataacacaagtttattccttctgccattgttttggatattgcatttagattgtttgcagtttggggctattataaacaatgcttttatgaacatttctgtttaagtgcactggtgcatgtttatttcgttttcttgagattatatacttagaatttgaattgcaagaacatggggaatgttggtctttatcaggtaatgccaggtagtttttcaaagtagttgtttagtggtttttacttcatttattagtatgtaagagttcttgtttcatatcccttaccaacaaccgtacgtggtatcatatatttcaattctagccaatcctggtgggtatgtagttgtatttagttttaatcatttccctcattactaaatggggctgaccagcttttcatatctgggtgtttggatttcatttttcataaaatgcctttgaaatcttttccttttttaaatcgaaacacgtctttttctagagttctgtattctgaatatatctccattgttggatgtatatattgcaaacattttttccatttagtagtttctttaaattaacagaagttcttcattttaatgtaaacatgttcatcagttttttatggctagtgtttctttttttaaaacatcatagagatactttgattatctttaaacctttttgtgctttgctttttcacattgacgtttataatgcatctgaaattgattttgtgtacaatgtgagatattcagagctttatatttagtaagggattcacttggtttatattgtccatattataatttagggcttggatattataatttaaatatatctggaactataaactactcttgaaatttttggctatttacatttgatgtggtatataattagggtaaccatatggcctagtttgccctggtggaaagtccttgtttgtgcctgctctggcataattattaaaaacatcccggctgggcagggtgactcaggcctgtaatcccaacatttccaaaaggtcaaggccggggtattgcttgagcccaggagttcaaaaccagcctcggcaatacagggagactccatttctacaaaaaattttaaaaagtgcattagccaagcatggtggcatgcatgtctgtcgtcccagccacttgggaggctgaggcagggggattgcttgagcccaagaggagctgtgatcatgccactgcactccagcctgaaacatagaacaagaccttgtcttaaaaaataacaatgatagcctgtaatcccagcacttcaggaagctgaggcaggcgaatcacctgaagtcagaagctcgagaccagtctggccaacatggcgaaaccccgtctctactaaaaatacaaaaattatctgggcgtgctggtgcatgtctgtaatcccagctacttgagaggctgaggcaggagaattgcttgaacctgaaaggcggaggttagagtgagccaagatcacaccactgtactctagcctgggcaacagagcgagactctgtctcaaaaaaaaaaaaaacacaaaataataataataatctgttttctcttttgaaaatgtttcagtgtggataagttatcacaccacataatcaaaagcctaattgcagaggtgctgtgaaatggtcgatgtgccttattttctgctagagatgtcacagactagctttagttctagaaagtgaaacaggtaagtttgaggggctttgatcctcggaacctaagcatatgtcaagaagtcataaaggcaacctagaaaggctttgatgtcaatctgctatgtatgtttatagatgatctgtgttgcagtttgtttctgcagtttgttgcagtttgtagtctgtgtcacagctctgaatttattttcttctcagcactgatcatgacttacacttaatcttctttgcttatttgcatatgtgtttattgtctgtcttcaccttccccttcacctccagactctgagctcctggtatgaaaggttgtttagttagtgagtaaatggaaatgatttagcattttagcttattgttcttgtagaagtatcttgggtatacctccaaataatgcttttccatgttcacaattgcatttccctataaaattaaattatcctgcctcacattaagaaatcttgaagaatttcagtgagtagggatgcaagaggatgaaatctagtgacataattaacattattggggaggtaaactctttgtgactcaagctcaattataattttcatttaaagtttaaaggaagcctccattcagggtgtaggaagaaattacacagtggtgacatgtatgaatattttatggaatagttccagttgtgtttgcacctacgtctataagtgagtaggatgcctaaataggctaaaatgaatgaaattcttataaaaaataaattcttacatttagttagcttacctggataatcattcaaatggaaaccaggttgctactgcactgggaaaagagactttatgaagaacgattatataagccacttgcctttaaaataagttgttcttaaaatcaagagattggtggaagaatagaaaaacaagtaaattgttaacagatttctttaatcatctgctaagtctggctcattggcataatttatctacttcttgatgttagtcacatagtcataaactattaccttattggagagagtggaagagctttgtgtgatggataaaatacttgcggggtgctttatttgatttcttgcattacttggggatctaaatctagcaattcacaaaattactatctaaaatgacaaagatctagtgaaacttcaagccacagtttctttttgttgccctatttagtgatgttgccagtacttggagccttggaaacagtttattattgttacatagtccgcagaaatacttggtaattctgggagtctgaagtcaggtgccagaaactgttcattttctagtaggggtaagtaaggtaagccatgattttctaagtcggaagtaaagaaaacagcataaaactgaagaaaaaaaatagtagaaggaaggaagtaggaagaaaaaagaaatcttatctgtgcatgatacatagcaggagttttgtatttaactcagtgccacagtaataatagcagtaactacagatagtttaacttgaatttaattattccgtgctagaagatgcttgctatagaaacaatttgtctttctctcatgatgctataaaataatatattaattagctgttttaaaaactagataccattgaagtaaattttgttgttgttgttttgagacaagagtctcactctgttgcccaggctggagtgcagtggcacgatcacagccttgacctccctgggctcaggtaatcctcctgcctcagcctcccaagtagctgggaccacaggcacacaccaccacacccagctaattttctgttttttgtagatacagggttttgccatgctgcccaggtcggtctctaactcctgggctcaagtgatctgcctgccttggcctcccaaagtgctgggattacaggtgtgagccacagtgtctggcttgaagtaagttttttagtggacaaagtgtgagttggtctgtaaaataatttattcccaagggccttattctagttttgtagggttttttgtttgtttgtttttttctggaagaaaatgcgacccaaaatgccagttggaatacttagcagctttttggtcttggacaagttatttaaccttagctttaacttcttcatcttttcaatagggatggataataatgcccatctttcagagtcattctgataattaaatgaggtgatataaaagaagtaactagtttaatgttggtgcttaatagagaatagctgtcccatgttatttcccaccacgatctccctctctgtctaggtgctcagtctctctagtagcccaactcagtcagtcattcacacctactgtagtctactgtcatcttactgcctttcactgtcctctcattcccctcataactttacttccttctttatcctgcttcaactccatgagcaaccacgacagtcagtacacattccctcagcccccaccccattcccctcttgctgtcttatacaagaaatcacaaccctgattatatcaacacagatgtgctgaccagcctcactctaaatttatgttcgctagcctccgcagtcatggtcacttcctagcagtcacactatacttccataatccatttcacttttctacatggctattccattcattttcctcaagcctccaacacctcccccatattcactttcagccccttaaccgtgctttctatagcagttaactgagaaaagaacagcaaacgaaagataattttgataaacttacccctcacatacccagttacctgcatctgttccccagacttctatgtttttttctgatcaatatggataaactgttcttatttctgtctaagaccacccttccacttgtgcagcatttgtcccctcttggtgattcaagaacattgctccagcagttctctactctcctcagtttttccttccctaacgtatctttctgtctgcttacagataggcagttatttcttctaccttaagaacaaccaaaaaaccccactgtacttgaactgaatttcctcttttctaatgattaccccatttctatccttccctttatagcgaaaccccttgaagaagttgtctacaccactggtgttcattcatttttgagccctgtttactaaggtttttattcctacatatgaagttttcttatcaaaattaccaaagatttccatgttaccaaatccagtagttagttcttagtctcattctacttcaccagtcagcattacgtggtacagttagtctgttctctgtgaagcattttcttaacttgatcgtatgccatttttttcctcatatctcactggttacctctcaatctccttggctgattgaacctgtaagccgccaaatgttgggagagctccagggctcagttatctccccttttctctctgtctgttaacatttatttaatcatctgcattcttttgatgatctcatccatctagttcctggtttcaaatactacctgtatatcactgactcctatctctagcctgaatttctcctctgaactcctgacttgtatatccattgcctctttaacatctctacttgtagggaagtctgctagaatctcaattcagcatgctccaaacctgttcctccatcagccttccccatctaatcaaatgacagctctattctagttggtaagaccaaaacaccttggagccatccttaattcctctctctctgtctcacctcatgtgatccgaacctatcagctctgctttcaaactagatgcagaatttgacctctgaccacccctactaccctggtccattatctctcactagtctattcagagatactcagattcctgtttcttgtttccaatattgacctctcagttgattctttctcctcctcccaattttacttgagtgaatctttgtaattaaaaaataaaatatatgggaaatgtaggtgacaaattttcttagtgaacctatgttttcttgtgcttgactggttggttggctatgtatttccaaattaagagtcttttttctgtggaactttgaagttactgctttttgttcttctaatattctggggttgctgatgccagtctgactctcagtcacttttctctctggaagcttttatttagaattctctattcctggaattcacaaatgtgatcacactggtttgttgttgtttgtttgttttttggtttggtttgatttttcctctgagtgtttctctgtggaccttgtgaatctgaagagtcaactctcggccgggcgcggtggctcatgcctgtaatcctaacactttgggaggccaaggcgggcagatcacaaggtcaggagattgagaccatcctggctaacatggtgaaaccccgtctctactaaaaatacaaaaaaaaaaaaaaaagccaagtgtggtggcaggcacctgtagtcccagctcttagggaggctgaggcaggagaatggtgtgaacccgggaggcggagcttgcagtgagccaagattataccagtgcactccagcctaagcgacagtgagactccatctcaaaaaaaaaaaaaaagagtcaactctctttaaatctaagaaatccattcattctctctacctctgacacgccctccctcccctctccccctcctctttctagctccatctcagataatttctatcttgcctcctgctccccagccttgttattgttgtttttaattcctcatggatgcgtttatcctccaccctgctttttcactcttatatcatattttcatatctgtctcttggttttatcatttggagattaaaatataaaaacagccataaggaagaatgcccaactgaaagcagcttagagagtcaacattaaatttaaaccattgggtaaagatagcaaactggacatgcttttacttttccttcctgttgataaatcctatcaaaactacgtgagagggacttttaaaaaatacataaacccggccgggcgcagtggctcacgcctgtaatcccagcactttgggaggccgaggcgggcggattacgaggtcaggagttcgagatcagcctgaccaacatggtgaaaccccgtctctactaaaaatacaaaaattagccagtcgtggtgttgtgcacctgtaatcccagctacttgggaagctggggcaggagaatcgcttgaacccaggaggcagaggttacagtgagctgagatcgtgctattgcactccagtctgggtgacagagcgagttcgtctcaaaaaaaaaataaataaataaataaacccataaaggacaaaacagatttggaaaggagacaacatcaacacagtttggaaggctgaaaagcaaatagatgagtttaaatgacttagcaaagttgagagccgcaacctaagtagtcagtgggaaaagccaagatgtaacttgactttcaccccaaactcctaaaaggctcaggagttgacatcaacaggcacaatggaaactagaagattgaagtaattgggatgaagggtgtaagttttgggttataagtttaacttattaacttttaactttattgggtataagttacaatactataaaattcacccactgtaagtgtgcggtcccgtgaaagttgtgtatccatcaccacagtccagttttctaacaattccatcaactcaagaagcttctttgttgatgtttagtcagtagctgcctacgacccccagtcctaggcaacctctgatctactttcttttctagactttcctttgctttttttttttttttttgagacggagttttacagttgtcacccaggctggagtgcaatggcgcaatcttggctcactgcagcttctgcctcccgggttcaagtgattctcctacctcagcctcctgagtagctgggatgacaggcatgcaccaccatgccagctaatttttgtatttttaagagacggggtttcaccatgttggccaggctggtctcgaactcctgacctcaggtgatccacctgcctcggccttccaaagtgctggaattataggcatgagccactgcgcccagcctttcctttgcttttaatatgtaaattattaaattgatttcctaatattaaaacattcttgcatttttagaaaccttaaatttcaaacaactgtatttctctatatcaattatcaattggagtaattagccattatctataatagattcattacatggagttcatggtagatttcagggagtcttgatcccctgaagttataagcaatttttatttacatacagaaacatttggggagagggttcatagatgtctttaattttccaagacccagataaatacaagctacctttgcttatgcctaagttaaaagttttaacatatcttttcacttttctccctttgtcccattttccaggttttatctaatttggggtttaggttacagattgttattattacattgcttctatttttagaatcccttaagagcagttttattagcaatgttgacttagataaaactgagggggcttttttgttttttgtttttgtttttcgtcagagacaaggttcttgaggacacaacatttaagctggggcctgacagatgagttagaattagccacatgtagaggctatctaggaagatgttaaggctatctgttatgttcagttacataagagagatcctttgtaaatgtgttttgctttgtaataaaccttctaaggagccagtattgttttgttattacatcactctctaaaatttcaaattgcctttttggttttataaggacaagatgggctcttaacaagatggctttggggttttttcagtcgaagatgatgtaacctctagagttaagtgcgaagaagttgattttgagaatatattgcagaaggtgcaaggaacgtcatctgggttatgacctctggaagtggaggtagttttttgtcattgggtcgccagtgcttggcatgtgatctgtgaggtgatcgagaatattgcagacacaagggcaggagtaatgcctctgttaggggtgttaagttcgtagtgggttcaggaagagatggtggaggctgagggacagatgttttcattcagtgcagtaatatttgctaacaggaagaaagtagtgtgggtaagggtgaagaaggggccagagaagagagtgcagatgtgcaaaaagtgagagtttgtggaagcaggccgtgatgtggttccaagagctggactgtcgaatcttatttttgtaaagctctgctcttaagtaaaaaacccagagtcacctttctaccatgctaccttcagggcctgagcaagagtactgcgttgtagaagaggtggtgctttttagtatttaagtaattaaaccttccttgttgtattaaatccatatataataccttattccaacatatctcagatagtttctgtatctcagatagtttcagcaagagtttgtgtatggcaccgaatggacaagagctgtacatatatataaatgtcagaaagagaagaaaaatactaactgtaactttttggtttcctggtttgctgcttttgcatgtagactgttcttaaatatgctgaggttgggtttgtttttcccactttcccattctatcaacatcagttgttatttactctaaacaatcattctttcattttatcctaagtgagtttcttttataatttaattcagttcccttggtattaaacactgttcagtactttggaagtagcttacttaatagctttttctgctgtgtgatttattcaagaaatattcaaatgtcagctatatgtagagcactgtgttagattctgtgggagttgcaaagatgatctagatacagatctttctccagatctttaaattctagaagggtagtatagacagaatgatagaatgctgtgtggttttcaaaggaagaacagattatttcagcccaggtggagttgggtgatggctaattttatgtgccaacttgactgggccacagtgcctagatatttgatcaaatattttcgatgtttctgtttaagtattttttgtatgagattaacatttaagttggtagattgtgagtagcctccatctgtgggtgggcctcatccagtcagtggaaggcctttaatagaacaaagactgacccctgagcaaggagttctgccagcctgctctgcagattttggatttaccaggcctccttaatcccttgggccaattccttaagtctctttctgtgtttgtatatgcacatctgatttattctgtttctctataaaacctgaccgatacctggaatcttcaagttgaaatttaggatagggggagagagaaaaatagaggacagaaaacctgatctgtgaactgagaataatgagctttgttagaatttaagtttgagtatgctgggaccaggtcttggagctgatacaggactgaagagttttaactttacatcataaatcttattctaagttttcatttgaacctggttttagtttcttaactttgtaagcgtcttttggatatttcagtgtttcatttgttgctctcaaattttggtattcaacagactcgtttctttttcttttcagttaacattagagtctaatttacaatttttagttcatgtcaaaaaaaagttcaggccgggtgtggtggctcacacctgtcatcccaactctttgggagtccaaggcgggcagatcataaggtcaggagatcgagaccatcctggccaacatggtgaaacccagtctctaatttaaaaaaaaaaaaatacaaacattagcctgggcgtagtggtgcacacctgtagttccagttactcaggaggctgaggcaggagaattacttgaacccaggaagcagaggttgcggtgagacgagatcgcgccactgcactccagcctaagcaacagaccaagactcggtctcaaaaaaaaaaaaaaagttcaggctttgggaaatttttttttttttcttttgagacagtcttactctgttgctgaggctgtagtgtagtggtgtgatcataactcactgcaacctccgcttctggggttcaggcaattctcatgcctcagcctcccaagtagctgggattacaggcgtgtgccaccacaaccggctaatttttgtttttgttttttcttaaattagagacagaggtttcaccatgttggctaggctgggctcaaactcccaacctcaggtgatctgcccaccttgccctcccaaagcgctgagactacaagtgtgagccaccatgcccagcctggaaaatgttaatagtgtcatttggagggtactagcttcacttaactatgtattttaagtatataatgtttatcatgcttaaatttagaacatttttggtattttataatggaggtattgtattgggaagtttgtcactacaacttatttctctggccttgtactatgattttatatacaagtattatatacactaacaaccagtttggcattaggatgatgtttgagcttaactaaatctggagactggattagatgagtgattttgccaaataatttgaccctgttttgttgttgttgttgttgtttgtttttttaatgcatgtgatgcatttctattaataaatctttggtgttatttcaagctagaaatataaaattgattctattttaagactaataaaattattagctgggcatcatggctcacacctgtatgtaattccagcactttgggaggctgtggtggatggatcgcttgagcccaggagttggagaccaacctgggcaacatggcgaaatcctatctctacaaaaaatacaaaaattagccaggtgtagtgtgtgtgcctgtagttctagctactcaagagactgaggtgggaggatagcttgagcttgggaggtaaaagttgcagtgagccgagatggcaccactgccctccaacctggactggatgacagagaagggacgctgtctcaaaaaaagaaagaaaaaattattagggcaatgtagcagcatgatgaagtttaaaatgtagaggacaaccacccctagtttccccattctccccaactacttttgtcattctctgtattctcttgtaggctgtatttgtaggtgtgtgcgcacatgtgtgtttgaagttgaaaattcacattacatgcaattaaccattatattgtgtacaattcagtggcacttagtgtagtcacagtgttgtgcaactaccacctctccttagtttcaaaactttccatcatcctactaaaatacccctaggcattaagtaatccctcttcatttcccccataccctgttgaccactaacctgctttctgtctccatggtttttcctatttcggatatattatgtaaaaggaatcatacactgtgtgacgttttgtgtctagcttcttttactcagcataatgctttcacgcttcactcttgatgtaacatgtatcagcattgtggtttttttatggctgaataatatttcattacatgtatttttaaatatatatatcatatatataagatatatagagatcataatttgtcttttgttgatgggcatttgggttgtttctaccatttggctgttttgaataatgctgatataaacatttgtatacaagtttctgtgtgaacataatataatctctggtactttgttttggcagccctagcaaactatattgtgtgctttatttccagtgtagtgcttagcccacttgctggactgtaacttccctgagggtggggacataaatataatgcctgcctaatattacttaaatattctaagcctgctgaatcactacattttcgttaattcatgataatccccaaaatatcccagaatcagatcagtatctattcagctacataatactacttaatagtagtagtatggcttactttgaagcctaatgctgtgtcagcttcagagattaagatgtcaggaaaccaatagtagtacttattagaggcattgcaagtggtatttagtgtttagtggaccttcaaatccaattcagtgatatcaaatccaagtaagcaaatagactgagctccttgagaataggaactggtttccctagcatctagcatagtacctgggacaggtggtgcccagcaagtatttgaaagaaatgggatgaaatgcaatgacatacggcacctatgttcagcttaaaactccagtcacattacctatgggtatttacattggaatgtgtagttgctgtagaatcccaaaatgaatactagaataacaatgttctttctcaaagtactacgtgttatgaatgaaaaaaaaaatgattagaacatagttcagattttgccagccagacaaaggcatttgtgctgtaatctgaggtatgccttcctgcactaagaggaacagggtttatgggaaaactaggattaggagcagaccatttgaaatctgtgcatctttgtaatttaagcactaatgtaaacctaataaaaagatagtagtgtgcttaaagataagttaaaatttttaaacaaataatttggtaaatttagaactttccctttaaaaacagtaaaggtgaccagaagtggtggcactactcagggctagctgtatttaactgttgttacctgcaaatgcaaaaactaaataacattttaggaaaaattggaaatgaaccaatgtgatttctgaatgtactgacataattcccttatttactgattgcatatgagctaatgtatgtgttgtagtagaatagttccagtagttctttaccttttctgtgcttatcatgcctccttcctttctactgttaatgttcaagttttaatcttccagacttctcatttgttctgtaacagtatcttctagccacgtgtgcccttctaatctctcttgtggaatttgttcttcacaatactacaagaattctattgcattgaaaaccccaaatcttattaagccagcctccatcattagagcatgtttctcaaactcttggtgtgtgcaaatcattcttattctgtgatttctattttcatgctttttcagtttgcttcatttgccatatgatagaggttttcttcagaccatattttggaaagtatgctcttagttttaaattctactatgggttatttccaagacccatagtagaatttaacaaattctttcaaataaaaaattttaaagccttcgcttattatcaactagccaaaaaaaaaaaaagtgtatcaagtgactcctacttgacatgatgagagatgaaagtgtaagtttagatactactactgtctgttgagtttcctctctctccattcattttaatctcccaatttttgttaaaatgttgtgatatactgttcttagtttgttacactttgtaactttgtagtcttttccagaactatttctattctagaaccaaagtaaattgtcatgtagacttctgtgttgaaatgaatttattgtccatttcttatctttagataacactttttttgagttattttgatataccaaagcataagtctctgtggcttgtagtggtctgttttttgtttgtttgttttgtttttttctggaaatacagtgaaagcttttgatgaaatttaggccttcatgttaagacatttctattctgttatatctttaattatatttttcttattcttttgtctatctcaggggcagcagttaactgttggatcttcataactatcatcttctctctaacctttttaatgctgtagtactttttcatgacatcttgtttaccttttctcaaaattattctcttctagtgatttggttttgctgcattgactgttgttgcatttattagttatgctgttttatttatcttgtgtaattttctttccttaattctgcatgctaccctttcaatgttgttttgatcataaaagtctatgctatctgtttttcttgtgaatgtcgaagcagttgtttcagaaaatttcttctattttctgtgataaatactaatactgaatgtatttcatctaccttttgaagactgtgtcctatcagggcaaactgctggtaatggaaaaaaaaacaaaataagtaaatgaagaccgtgtcctctttgattcttctcttcttctttactgccttttttctttattttgatacacctttttctttccttccatcattgcctccctcctttccctcttttcttcccttctttccatctttcctgtaaaatttttcttgattccctgatttttctactctttttttctttagtaggtcctttcagtacctgctgcttgccaaaacgtgaaatgcagattctctttttacttgactctgaattcacctggctaagctctgttaggccttaggaagcttaatagagcttctctaattttgtagaagaagggcctttgactttttccctctctgcttcaggatgatctcatctgctactttggaagcatgagactttatttgttttgatggtactgaggttaggggtgagattgatttatttgtaattagtcctttctcctccttatccttccttttggataaaggtaaaaatataaaatcctcctgcctgctaaagtactgtttggccatcagagaaagggagcttcaggtagggcattccgcagtccctgtccccatcttagcaagttgaagatgctagtcaaaatttctctggggggcaggagagggcagaggatacttacgtatggattctggggttggtctttcagtttcaactaactcattctgtacctgaatgatactatttaataaaatttcgtggtatgagtttgagaacttgtcatgattttagggatattttaacttcctttttgtttctttcctttagttttagggaaggatcttctgccaaactacctgtgccactgtctttcctggaagtctcataagtactagaaagaacttttagaataagagtgtaggacattatttacactgaaataacattctttttgttgtttttttttttttttttttttttggagtcagattgtcattctgtcacccaggctggagtgcaggagcgccatcttggctcactgcaacttctgcctcttgagttcagccaatcctcccgcctcagccacctgagcagctaggactacaggtgcatgccaacatgcccagctaatgattttttgtatttttagtagagatggggtttcaccattttgttgaggccggtgtcaaactcctgacctcaagtgatctgcccaccttggcctcccaaagtgctgggattgcaggcatgaggcgctgcatcagttctgcaaaaaaaaaaaaaaaaaaaaaaaaaaaaaaaaaaagcgtatgcattaaaaatactaagggggccaggcgcggtagctcacgcctgtgatgccagcactttgggaagccgaagcggatggatcacttgaggtcaggagttctagaccagtctggccaacatagtgaaaccccatctccgctaaaaaaaaatacaaaaattagctgcgcatggtggcacacgcctgtaatcccagctgctcaggaggctgaggcaggagagtcgcttgaacccaagaggcagaggttacagtgagccaagattgcgtcactgcactccagctggggcaacagaatgaaactccatctcaaaaaaaaagaaaaaaaatagaaatgttaaggggtttacttcctttagggtactctttaaatgaaatatgatgtttcatattctctatttggaacttctgtatggatgcagacattttcagaaatctcccaggacaatgaacctgaaacttatgtatttataagaaacttggggatttggttattttatttacttattttgaaatagggtcttgctgtgtcacccaggctgcagtgcagccacgcttcagtacagcctcaatctcccaggctcaagcgatcctcatacctcagcctccttatagctgggactacaggcatgcactaccacacctggctaatttttaaaaatgtttatttttttgtagagacagaacatcactgtgttgctagggctggtctcaaactcctgggctcaagcagtcctcccaccttggcctcccatagtgctgggattacaggcatgagccactgtgcctagccagaaattggcttaaaatgcagatttttggaccctgtccccagcaaaaagattcggtagaaatctttattcgtagccagtttactgtgttgcaggtggtccccagtttaactttgagtaatgctgtcttcattgttaaaataatcagatttaattatatggtagatattttaggtaactagggtatttcaagctgtcccatggggctgagtagctggcagctgcttgacttggcttctagaggacttactgctcagcaaggtaaatgttattaataccttcattgctctctgtgtcccaaaggtcaatacccaaactttgagattttgtagactggaggaatctttgtctcccactccttccccaagaaagacatgggttgctaatttttattttgtcgaatgaggacattaaaaataagttaaccgtgagccaggcacagtggcttaggcctttcatcccagcacattgagaggctaaagcaggaagatcacttgaggccaggagttcaagaccagcctgtgcaaaatagcaagacctcatctctactaaaaaataaaaaaagttagctgggcttagtggcacatgcctgtggtcccagctacgtgggaggttgagatagaaggatcgcctgagcccgggaagctgaggctgcaggaagccatgaccacaccactgcactccagcctaggggacagagacccagtctcatcaataaataaataatgaaaggacattttaacaccccactacaaccactaaagatacaaataaataaaaatataagaggaacacaacctcataatacagatagtcttttatattgcatatatttaacttcgggcaaaagccactctattttcctctttaaaaaaacttttttagctatagattaatgaatactttctcagacatttcagaactactgcttagtacttgaaatacaacatttagaatctggggtactacctgaatgtgatgagtagtcacacatctcatatcctttgttttcttgccagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcaggtaactgatggtaaatttgtcttggagtacaggtaaactccgcacagggttagccttggcttttttctctctagttgaatgttcatgtagcttatcatttccaagttactgggatacctgaaattactggataatgttctcatctaggtttttctctttgtatcataaattagaactaaggtaagaaacagctgaggaatttattatgaaatattttctaatttcaacaacaattaccatagctaacattgaaggctactctgtagaagtgctgtgcatataagataccctctgaggttggtactataattattctcacttttaacaagtgaggaagttcagatggagccacaatttgaacagatccaggcagcctgcttcagaatctaggatccgtgctaccatgctattgagatatggtttatattgcaaaccaaggcaataacagctactcttaggtaagattattaggcttaatggggaaaaaaaagcaaaatcacattgttctgcatatgttataatatgcagtgttggtttttgttttgtttttctttttctttttttttttttttgacagagtcgttggagtacagtggcgtgaactcggctcactacaacctccgcctcccaggttcaagtgattcttctgcctcagcctcctgagtagctgggattacaggcatgcaccaccacacccggctaattcttgtatttttagtagagatgaggtttcaccatgttggccagcctggtctcaaactactgacctcaggtgatccgcccacctcagcctcccaaagtgctgggattacaggcatgagccactgtgcctggcctgcaatgttatataataagaaaacacaaacatcaatgtattttaacatatttagatcagctcttaaatctcccaatttaagctttttaataaggaattgtaaattttgttgcagcataagctggagaaattctctactctcatctacccctacccttgttaagtcttattttggtgaaaggaagcctgaagtggaaatgtgaatctctttaaatggagaaggaagagacacattcttaatagagatagctccctacaccaaacactggagttaccttactgtctcttttatatggcttttgataattctccaggaaaccagttatttgagtaatcggttttatggaaggagaaaaactaagagagcgcatatgaaaatggtgttgaataacttcttccaatcatcataaacttctacttgatctccttattcattcattcagtagtatttacagagtatctggcatgtgcttaacactagtggtgaacacacagaaaaggtcctgccatcagtgagtgtatgtcctggtagcctttaatacacttcatgtttatattatgaaacagtttatagtaagataatatatgaagtatacatgtattaatatatgttatatattttatatgctttaggtttaagttaaagtttttataaaatgttcctcagcttaatgtaactataagtaaaaatgtaaatggttttatgtgggatatgtttgtttctacgtctgtgaatttaatagtaggcctcaaatgattgaaaataagagtaaaatcatacgtgagatttatatcaacatcagactaaaactcattattactaagtgtgatttttctcatatttttctttaagcaaagttactttacttaagtaactttaattctttcctcaatctataaaactcttaattcaaatggggagtttattgtagaaaaaagtatttgtaagtcacattgagtataattggcacattatagacagatactgaaatcaaaaggttgtttggctattttaatattaagtgcatattgtaattcattttatatctagtagttataatttaatagttttcttaaaagtaaaaatctggaattttttttttcgttatatacatgttgcttagagcttggaaacataactcatgattttccttcagtcctcactaggctcatcgacttcttcattccagtccatgggttcttatggacctttcggcaggatgcccacatacagtcagttcagtccgagttccttagttgggcagcagtttggtgctgttggtgttggtatgttttctttttcttttctttttttgtttttgtattcttcctttctttaccacaaaggtatagaaactcaacaccaactattagaaatgttgtttgatgttccttttgtaactttgttttatggtattcagaacacattttgatgatatcttaaagcctttattgatattagtgggtttttaaaagtcagctttcacagagtaacatttttttttactaggtaaaaaaaaaatggatatactaggtatatccaatatctaccaaatctaccaaattggatatactaggtatatccaatatctaccaaatcttattggtaattggttttgttttgttttttttaaagacaaagtctcactctgtcactcaggctggagtccagtggcactatcttggctcactacaacttccacctcgtgggtttaagcaattctcgtgcctcagcctcccagatagctgagattacgatatgcatcaccacacccagctaatttttgtattttcagtagaggtggagtttcactgtgttggccaggcaggtcttgaactcctgacctcaggtgatccacctgcttcggcctcccaaagtgctaggattacaggtgtgagccactgcgcctggcctggattttaattaataaatttttctttttaatttctttttctttttttttttttttttttttttctgaggcagagtcttgctctgttgcccaggctagagtgcagtggcatgatctccgctcactgcaacctccacctcccaggcttaagcagtgctcctgcctcagcctcctgagtagctgggattacaggtgtgcgccaccactcccagccaatttttttgtatttttagtagagatggggtttcaccatgttggccaagctggtctcgaactcctgacctcaagtgatccacccacctcagcctcccgaagtgctgggattacaggcgtgagccaccaagcccggcctaaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcgtttaaaccatggtaaagaacagcttttaaaaaaaaatcgcttctcagccttttggctaagctcaagtgtaaaaaaaaaaaaacagctttaaatctcaagcttttgcccctaatcttttaaaatttcattgaaataattatcagtttactgtttcactgcaccacaaatttagtttcaggtgtatcttgaaactcattgatatgctaataagttttattaaaattgttaaattccttcctgtgaatatactttttatacagatgtgacttaagtatttaaatgttttacttattcacaaaataacaaagaatggcaaaaaaaaagcaaactaaaactgaatgagctgggcgcggtggctcacgcctgtaatcccagcactttgggaggctgtgggcggatcacctgaagtcaggagttcaagaccagcctgaccaacatggagaaaccccatctctactaaaaatacaaaattagctggacgtggtggtggtgcatgcctgtaatcccggctactagggaggctgaggtaggagaatcgcttgaacctgtgaggcagaggttgcagtgagctgagatcgtgccattgcactccagtctaggccacaacagcaaaactccgtctaaaaataaataaataaataaaactgaatgaatataaacagaaaccacagatgctattacatattaaattgataatataaccacacagagggctgggtgcggtggcttacgcctgtaatcccagcactttgggaggccaaggcgtgtggatcacgaggtcaggagatcgagaccatcctggctaacacggtgaaactccgtctctactaaaaatacaaaaaaattagccgggcgtggtggtgggcgcctgtagttccagctactcgggaggctgaggcaggagcatggcgtgaacccaggaggcggagcttgcggtgagccaagatcgtaccactgcactccagcctgggcgacagagtgagactccgtctcaataaaacaacaaaaaaaaccacacagaggaaaaaataattcaggtaacttttacactcttagtaggatatattctaacaacaaatagaactactaagaaaacttgactttgatttgtattattggtgttattatttatttatttatttatttattttgagataagatctggctctcacccaggctggagtgcagtggcacgatcccggctcattgcaacctccgcctcccaggctcaagccatcctcccacctcaacctcccgagtagctgggattataggcatgcaccaccactcccggctagatttttcttttgtattttttgtggagacagggtttccccatattttccaggctggtctcaaacttgtgaccttgagtgatccgcccatcttggcctccaaaagtgttgggattacaggtgtgagccactgcacccagccaggtgttaattcttaaactgttttgtatgtattataggaaagggcaaatgaataaaatacttatgttgggaaatagtgtttttaccatggagacggaagatataaatatggaatgggaaaggtgagaaagaaccctgtggtgctgaatgtaaatagatggtatgtgtatggactcattttttaaaaactggttatttcctagctctgttcgtagaaaggacctagaaacaatggaaaccccgtagcaagggacacatgtagactcagctcttagtttctaaataccactccccactaaaaggaacaagggcccattgaaaaacaaaggaaaagacatacttttttcatataaaaatgcctgctaataagtagaagcagtggtagataaagaaaattgccattttctaatctcagtataataattagcgaggattatcattagatgctgaagtcattgggtgaaaggtgttaggacagcatattaaggtggtcttaaagtatcatcccacaatttacaaagggggaaaaatgtacccttgtaacacagacatctggtggttaccaacttcgttgagtgctcaagtttagcattgccatgaacaattatgtgtctcctgttgtgatgattggggtggggggcaaaacataatatcacctttgtggggttcttgctgaaaatacagaatctaattttgaagaaatgggcttatatatccagaaggtgggttgttttgcgagacagttatccacactcttcaaaagattcaatattacaaagaatggagagaggcagcagaactgctttaggctggcaaagactgaagagacataacatccaaatgtaatatagaatcgaatactgggcttttaaaaagttggcgtgtttgtttcctgcaggggagaaaaagaaaacttaaaaagttggtgtgaagaacattttagggactactaaggaacttttgagtatggactaattgttggattttgttattattgttaattttctggttaatcatatgggaaagtgtttttgtttgggggaggtggttttgaagtatttaaaagtaaaagggccaaattgattttagcctctctaaacaaaagaaaaatgtgtatattaaggtataaagatggagaaacagagtgggtttggttagatgttaacagttgatgagtctaggtgaggaatatattgatattctgtgtactccttcaattttaacataggtttgacatttttcataattaaaaattaattccttttagacttactttaggtgaaatagtgtaactttggtccataaatttccaaatccagtagtaagatcaatgttatttattcatgttaaatcaagatatactgtatgttaactgtaacttagaatcctttcctggggattcaagtaaggaatgattgcaaattgtattatcctttttgaggctcctttgactaaattaaatagttaactgactttgagatcatcattatacttcttatgttaccatgaagtttatgtaactaattatgttaaaaaatttgaacaggatcaagcacgtagtatctatatagtaactattgcttctgccattcttcaaggtttactttttaatcagagtattttgtggttgtgaaatgcttttataaatattttaatctaattttaatattattgtgggttgttggtttattacttgggtgtcacaaaagtagaagattttactggcattttccatgtcagtagagtaatttttgcagggtcagattatttttgattaattgatttccatattggttaggataatttgtggagtggctaattagaaaactagtgttagaagttaccaaatgaggaagaggaaagctgtggcattggtcaaggtgacagatgtttttcagaaaaggaattaacttaaatttagcttgttttttgagatggcgtcttgctctgtcacccaggctagagtgcagtggtgcgatctcagctcactgcagccccctcctcccgggttcaagcgagtctcctgcctcagcctcctgagtagctgcggttacaagcatgtgccaccacgcccagctaatttttgtatttttagtagagacagggtttcaccatgttggtcaggctggtctcaaactcctgacctcttgatccgcccgcctcagcctcccaaagtgctgggattacaggcgtgagccaccatgcccagccaaatttagcttttgttggcacaaagtaaaccacattttaagctaggcctcttttcatttttggttcctagtattctgattttaaaaggaaatttaaatgaatctggatcacagtattgctatttgatgagaaaatttttatatatttacgttttcgtgtgttattactattgctttttatttttatttatttattttttgagacagggtctctttctgtcatccaggctggagtacagtggcacaaccacaggtcgctgcagcctagacctcctgggctcaagcagtcctcccatctcaacctccctagtagctgggactacaggcatgtgccatcatgcccagctaatttttgtatttttggtaaacacagcatctcagcatgttatccaggctgatctcgaactcctgggttcagtctgcctgcctccgcctcccaaagtgttgggaaccaccatgcccacccttattattgctttttagtaagtttttttttttttttttttccatttggttggttggtttggtttttgttttgttttgttttgttttgtttttgagactgagtcctgctctgctgcccagcctggagtacaaagacgttagcactttgggaggccatggcaggaggattgcttgagctcaggagttggagaccagcctgggcaacatagctaaaccctggctctacaaaaaaaaaaaaattaggcaagcatggtggcacactcctgtaatcccagctgctccagaggctgaggtggggggattgcttgagcctgagaggtagaggttgcaatgaaccaagagcacgccactgcactccagcttgggaaacagagccagactgtgtctcaaaaaaaaaaaaaaaaatcttgcttatagtgaaaaacatacaaattaaatctacactgagacaccatttctcactatcagtttggcaaaaactcaaaagcttgattatatgcatactcttggcaagtatgtgaagaatatatactctcatacattgagaagaataatataccaggtagaattaaaggactcactctgttgctgcccaggctggagtgcagtggcgcatctccgctcactgcaagctccacctccctggttcacgccattctcctgcctcagcctccctagtagctgggactacagacgcccgccaccacgcccgggtaattttttgtattttttttagtagagacggggtttcaccgtgttagccaggatggtctcgatctcctgacctcgtgatccgcccgcctcggcctcccaaagtgctaggattacaggcgtgagccaccgcgcctggcggacttttcttaaaactgatgcaaaaataattcttatgtgtaagagattagatcattactggccttaatttctgaactcttggaaaaattaaacacctcacaataaatgaagcatcaaaacagtatttccctgtgttaccattgaacagtagcaagagcttactgctgcagttagaaaaaggattcatagaaacagtgaaaggtatagattgaccagctatctaaagtaattctatagcaaggattacagtgaagaaacatggagcaattagatgttttttctgttatatttactccagttgattgtttaagtctcataatcttatgtgccagatggaggagtattggctgaatagaccatcagtgggtacattttagttgattaaatagccaaaccatattggaggatggttctcttaggtctccagtgttttgtagagactaatttttaatcactgagtgatgaagccttgaagagatgcttacgaactttacagttagcataaagccaggggggtgtttcaaccattatggatgttaaactaaggattattaaagatcagaccaggcacagtggctcacgcctgtaatcccagcactttgggaggctgagacgagtgaatcatttgaggtcaggagttcaggatcagcctggccaacacagtgaaaccctgtctctactaaaaatacaaaaaaaatgagccgggcttggtggcgtgcgcctgtaatcccagctactcaggaggctgaggcaggagaatccctggaacccaggagatgaaggttgcagtgagttgaaatcatgccactgtactccagcctgagcaacagagcgagaccctgtctcaaaaaaaaaaaaaagaaagaaagattgttaaagatctactttggtaaaatgtgaaggaattaaacattccagttaaaaggcagagagtgtcagactgaatttaaaaaaaaaaaaaaaaagacaaggcccaactatattatgtttataagaaatgcactgaaagtgaaagaatagaaaaaggtataccatacaaacagcaataacaagaaaagtgtgtagcatacgttaatatcagacaaaggagcttaaagatcaggatttcttccagaggtaaaggttgggggggcgttcttcgtaaagataaggatcagttcatcaagaagatacaacagtcctaaatgtgtaacttttataaaacagtatacccaacaattgcagaatattgttttaagtagacatgaactgctcaacaatatagaccaaatgctggaccataaaataagtcacactaaattccaaaaggaataaaatcatacatggtatattgttaaaccacaaaataaacttgaaattaataaagttaacttgaaaaatccccagataatttggtatcaagtaaacttgttaatcactaatggatcagaggagaatttacaagggaaattagagaatattttaaatctagaccagatgtgatagcatacacctgtaatcccagcactttgggtggtggccaaggtgggaggatcacttgaggccaggagttcaagaccagcctggggaacatagggagaccttgtctctgcaaaaaaaaaaaaaaaatttaagtagctgggtgtggttgtacatacctgtagtcctagcactcaggaggctggggtgggagacttgattgagcccaggaattcaagactgcagtgagctgtgattctgctgctgcactccaggaaaggcgacagagctagaccttttctctaaaaagaaaaaattaaattaaaaaaattttattttcaatttaatgaccagaaagtttgtgggtgtagctaaaacagtgtttagaaaaattttcatagctttaaatacatgtattagaaaacaagaattttcggctgggcgcaatggctcatgcctatgatcccagcactttgggaggctgagatgggcagatcgcttgaggtcaggagttcaagaccagcctggtcaatgtgataaaaactcgtctctattaaaaatacaaaaattactcaggcgtcttggcatgcgcctgtagtcccagctatttgggaggcggaggcaggagaatcacttgagctggggaggcagaggttgcagtgagccaagatgacgtcactacactccagcctgggttacagggcaagactttgtctcaaataaaaaggaaaagaaaataagaatttttaaaatcagtgctttaagctaccagtttaagaagctaggaaagggccaggtgtggtgtctcccacctgtaatcccagcactttgggaggtcaaggcgggcagattacctgaggtcaggagttcgagaccagcctggccaacatggtgaaaccccatctctacaaaaatacaaaaattagccaggtatgatggcaggtgcctgtaatcccagctactcaggaggctgaggcaggagaaacgcttgaacccgggaggcggaggttgcagtgagccgagatcacaccattgaactccagcgtgggcgacagaacaagactccatctcacaaaaaaaaaaaaaaaaaaaaaaaaaaaaaatactaggaaaaatggttagctgggcatggtggtgaatgcccttagtcctaactgcttgggaggctgaagtgggaggattccttgagcccagcagttcaaggttgcagtgaactatgattgtgccactgccttctagcctgggtgacagagtgagaccatgtctctaagaaaagttggtgaggacgccaggggacagctaggaaaaaaaatgaaagaaaattattccaaaagtagtagagggggaagaaaataaaaagataagagcagaaatcaatgaagtagaaatagattatattatcagcaaagtcaagagtttgttttgggtgggtttttttattttttatttttattttataagattgataagtccctaacaaaactgattaaggaaagaaagaacaaccaagcaagttgccaataccaggaatgaaagagtagacgtcagtatagaccttaaaagaataatatgggaatatatgaatgtcaacaaatgtgatagtttggatgaagtgggcaaatttcttgaaaaatagcaaaccaacacaagaggaaataaaatctcaatatctctatatcttctaatgaaattgaaacagtaatttaaaatcacccagaaagaaaattctagactgtttttactgttacattctaccaaacatttagggaagaaataattttcactaatcttacacaaactctttcagatagctatgcaccatgatgcatgcctgtagtcccagtaactcaggaggctgatgcagaaggatctcttgagcccaggagttcaaggctgcagtgagccatgattgtgccactgcactccagccaaggcaacagagcaaaaccctgtctcttaaaaagtaaaaaaagactgggtacggtggctcaaacctgtaatcccagcactttgggaggccgaggcgggcagatcacgaggtcaggagatcgagaccagcccagccaacatggtgaaaccctgtctctactaaaaatacaaaaaaaaaaaaattagttgggcatggtggcgcgcgcctgtagtcccagctgctcgggaggctgaggcaggagaatcgcttgagcccaggaggcggaggttacagttagctgagatcgcgccactgcactccagcctgacgacagagcaagactccatctcaaaaagaaaaaaagaaaattcagagaatacaggaagaggaaatatttgctgaccctataaccaaggccaaataactgaaataccaactgtgactggatcgttacaagaaaattatagatcattgtcccccatgaacataaacgtagtaatgtttattagatgtagaagccagcacttcagaagaaggattgtatatgatgacaaagatttatctcaggactgcgaagctgcaacatttgaaaatcagttgtaacttaccacgttaacagaccaggaataaagaatagagaatccagaaatagacccactcagatacttaaaacagagtaccaagacagttcaatggagagaaaagacattgttttaacaagaggtgttgcagcagctgtttatctgtggaaaaaataaaacttgacccctggcttaaactataaattaaaaataatttggaatagattatagacataaattggtagtagaattggagtagagcgaggggggtgtggcacgatcaggaactcacggaagagatttgctctaaccattgaatgcgtaatccagaggacaagcaatgggaggccaagccaggtgaggaaacacagagcagcctggagatgcaaatatacatcaaagtggctgatgtcttggtcatcacccaggaatactagaaataactggatgggttctactccccacagaattcttgaaagcgctagtccccacattaccgggatattgtgggaagttgtattaggcttctcctgagcttactggagctgcagccagactggactgcacctccaagggagtcccagtggctccccttgtctaagatactgtgctgctttctgaagccacatttttttttttttttttgagacagagtctcactctgtcacccaggctggagcacagtggcccaatattggctcattgcaacctccacctcccaggttcaagcaattttcctacctcagcctcctgagtagctgggactgcaggcatgcgccaccacgcccagctaatttttgaatttttgtagagacgaggtttcatcatactggtcaggccagtcttgaactcctgatctcgtgatctgcccacctcggcctcccaaaatgctgggattacaggtgtgagccactgcgcccggccctaaagccacattttaagagggataagaacaaatagaattcattaaattaggagtccaagaaaggaaggggagagtgtcctaaagaccatgtgaagtgagtaatggttgaagggactggagttgactaacctgaaaatgagcaaattgcaaggggcatgattgtaatcttcatgtgttttaggagcagaaggataaacttctgctgtgggctagactggtgaaaatatagaaaatgttgagagaagaggtaggttttattaactgaagtgaatagtttgaacttttatcttgaggacagtggaagccaccagaaggtctaaagcacgataatgttattacatttatattttgtaaagaatcactctgactaccatctttaggttggatttagaggttgtggaagggggaggtactgttgaaatatagtgaaaacctgcttagatgaaataccaaggaaagagcacagtatatcaaaagtgaatgatccctaagtactgtagaaacttagagaagaaatttgatataacctagtatggcagagaattgggccctttctagggacctttttactcatattgccagaactttttgcagctgctttaggcagaatgcagcctcacagtcctatcttaaggggaagcattgaaaccagagtccattgtctattgccttggaaatgctaaaaaagctcctcgtaaacctgtctgctgatttggctgtttgtccagatacttagtattagaatcactgaaccttaatgttggtgttgaatgtaccatttctgctacttctctagttggtatgggtccttgctgtcccatctgcataactgcctaggacagcactccatgtgttataaacattgcttgcatccaaggatagtggacagtatattggctcccccttcccctgccctccatattgccataaaattcccaaactattcagtacactttaatttccaagattattaatttgtacagatgctggggggagaggtagacaattaccatcattaaaatgctgcattactttatatcattgaataatgtcaaacattttttaaaatttttttatcatttaaaaacatctctttaagctggaagctctttgacatcctttggaacagaaacatcaaacagtggtaccttaccccaaagtagtgcggttggttctgcctttacacaggatacaagatctctaaaaacacagttatctcaaggtaagctatctcatccctaaaatatttccattctaaacttttatagtggtttttgtctttctgaatgtaagagcttttgcagcttgtaaatcgcgtgtataatttctatttggctcttttaaaatttttctccaaatcgctgtattgcaatgaatatattattgaatgactctcactatttagacttattacagttcttagatcatgaaactgaaatgctgagcattctctaagttggactttttttgcaaagcaattatataacttgtatgtaacacttaaatatatcaaattaggctcatactcaccattaaagttgagctatccaagatgaattggaaatatcatctgaaaaaaactgtattatgctgttaacattttccctaacatcctcacaggatggagagtagtggttctcagtgtaggctacccacaactgaatcatctggggtgcttcttaaaaatttaaatcctgagacttatacatcagaatccctggagcctgaggatttatattttaataagcttcttaaaggattgttttatttcttaagattctgctcttcaaccagccagtctcataattttaaatggttatccataccttttattcttatctttgtttcttccttttttcttaatctttttctttcttttatttacttattagagatgaggtctccctgtattgcccaggctggtctcgaactcctgggctcaagcgatccatttgccttggcctccccaaagtgttgggatgttgggattacaggcgtgagccattgggcctggctttttttttttttttaaagataggtctcactatgctgcccaaactgaaatgcagtggctatttacagatgtgatcatagtgcactgcagccttggacacctggccccaaacaagcctcccactttagcttccccagtagctggggctacagccttgtgccaccatgctcggcttttccttatctatttttatgcactttagaaatgggtatttttggctcattgctttatatgaatggtttttgttttgttttgtttttaagtaaaacaatgttgagtcatttcagaaagacctatagtcacaagacagtattttaaaaagctattaagggtaaaaattcaatgctaaacataatcttatgtatttcacttaagatattttgaaatagttcttactgttactcatattgattagcttaatttttttctttttttttttcttttaagatggagtcttgctctgtcacccagactggagtgcagtggcacaatctcggctcactgcaacctccacctcccaggttcaagcgattctcctgcctcaccctcccaaatagctgggattacaggcacgtgccaccacgcccagctcatttttttgtatttttggtagagatgtggtttcgtgatgttggccaggctggtctcaaactcctgacctcaagtgatccacctgccttggcctcccaaagtgctgggattgtagatgtgagccactgcgtccagcctacttgcttaatttttaaacattctaaagattgtttgtttgttttttgagatagggtcctgctctgtctcccagactggaatgcagtggtgtgatcatggctcactgcagcctctacctcctgagctcaggccatcctcccaattagctgagatcacaagcaagcaccaccagctagttttgtagggacggggtttcgccatgttgccaaggctggtctggaactcctgggctcaagtgatccacccaccttggcctcccaaagtgctgggattataggcatgagccacagtgcccggcctattctggaatttttagttaaatcaggaacacatgaaaaagaagcataaatattgaaattagcattattcatgaagaatgagaactaataaggaacttaaattaggcacaggcaaaatgtaaattaaatatacaaaagtcaatagttctggccgggcacgatggctcatgcctgtaatcccagcactttgggaggccaaggcaggcggatcgcctgaggtcaggggttcgagaccagcctggccaaccaacatggtgaaaccccatctctactaaaaatacaaaaattagccgggcatggtggcgtgcacctgtaatcccagctactcaggaggctgaggtgggagaacccgggaggcagaggttgcagtgagccgagatcacgctactgcactccagcttgggcgacagagcgagactccatcttaaaaaaaaaaaaaatttaatagtcctaaagcctaatccattgattatgtaatgaggagaaaagatgattacagtaatgcaaaatagaaattgtatacaaaatatataataagaaataagttggtcatactaagaaatatgaccaacttctatgataaataatgtaagacagggacataaaagttgcatgtaatggaaaaaacatatcttattgctagatagaagaacaagaacagtaccagcacttagggaggcaaagccaggatgatcacttgagcccacgagtttgagaccagcctgagcaacgtagtgaaacttcatctctaccaaaaaattttaaaaataagcagagtatgatggtggacacctgtggtcctagctactcaagaggctgagacaggaggatcacttgagcccaggaggccgaggctgcagtgagccctaactgcactacctcactccagcctgggcgacagaaccaagaccctgtccccccccaaaaaaaaaagatgttgggaagactttactcctcatagttaacaaatttattgcaaattaattaaaaatcaatgcaaatagaatagtaggagaacttagtaaaacagtttatctttaaaataaacatggaagtgtggctggacatatttgaaaaataaaagtaatgggtttactgacatgataataaaatgtagcaatgcaggaaaaaagaaagagatgaatagaaagcaataggcaggcagaaacagatccgagtataaataagaatttatcctgggtgcagtggttcatgcctgaaaccctaacattttgcgagttcaagatggaagccagggatttgagactagcctgggcaacataccaggaccctgtctctaaaaaaattaaaaattagttgggcgtgatgtgtgcgcctatcagcttgagaggctgaagctagaggattgcttgagcccaggaggttaaggtggcagcaagctgtgattgcggccctgcacactagcctaggcaacagagcaagaattcatcttaaaagaatttagtagatgataaaggtattattttaaattagtggagagaaggctgtctgttccaattaataatgttgcctgatcatttggagaaagtcactctagattctttccctcatactgagcaccaaaaaatatataaattttaaatagattaaaatgttaaaaattttgaagtatgtgtttattaaaagaaagaggtgtatttacataaagttatgacaaatgacaagtcctaagagtttgcatttaagttttatcaactaaaattgctgaatttcacaaaattaaaattcctagaattttaagtgtgataagattgtgaagatagctcaagggagtgtgtctataatatgcagaaatcacttctggatttattcctaataatgtatccagtatcacagtatcacctgtatttccctgtttataacaaaactggcatcatgatgattagtaggccttaatagtgaaaaggctttttaagtacacaacaaatgtttctgtacttgctccgattgccccattgcttgtacttctgtagtacttgtgagccataggatcttttctcaaaagccttgataaagaagttttataaacttataagatgatttaatgtagtaccataaaattaactgtagcagtaggctttttcaggaagacatgtgaaataaaaaaaattagcaaggtgtggtagcgcacatctatagtcctagctactcaagaggctgaggcaggaagatcattgggtcccaggagttagaagttgcagcgagctgtgattgcgccactgcactccagccagagcaacagaacaagaccctatcctgtccctaaaaaacaaaaaacaaaatgtgttttataagtgattataaaatgtttttttcataggccaaaacttacataaaccatgatttcccattataatccagtggaaaaattgtaatgcttctattagtggtaacttaattttgaaatgttaagtagattgtgcctgtgtcggtttctgggttttgataaatgatcatttatttggctaactttgccattaatggctgaaatggtattgcacatttgtaagtgcatactttagataatcataaattggggaaatattactaataaattatccctgaatcatctaggtacataataatgcattgtcagcactcaccagttgtttgacacctgcaaatatgcacagatggacagtaacatttgcagcatatttgggggatttttttacgtgaaatgagcattttttttaagcaaaacattatattttggaataattatgagatgtgagtgcctaagcagagatgtacagcaaacattatcaggacagaaagcatgatgggagcacccgatgttacattcttcagttcatgctgtgaccaggcgacctcataaaaggaaaaatataatgtataagtacaaaccccattttttgttttggctcttttatatttgtattttttgagacagagtctagttttgtcacccaggctggatgcagtggaccgatctcggctcactacaacctctgcctcccaggctcaagcaatccacccacttcagccccctgagtagctggggttacaggcatgtgccaccacacctggctaatttttgtattttttttgtagagacaggctttcgccatgttgttcaggctggtctcgaactcctgagctcaagcgatctgcccatctcagcctcccaaattgctgggattataggtgtgagcaaccgcgcccagccaaaccccatattaagcaaaaacttgccaagagatcttttaaaaggcaaggaatgagtatggctactgtgtaattatctgaagggttttttttgtttgttttttggttttgtttgtttgtttttttgctggccttttagtttttatgtttaattacccaagcccctaaagcattaaagaacttcacctatctaactttgtagttcttttactttatttatttatttatttatttatttatttatttatgagacagggccttgctctgtcacctaggctagagtgcagtggcacaatctcggctcactgcagcttctgcctcccgggttcaagctatcccatctcagcctcctgagtagctgggaacacaggcacgcgccaccacgcctggctaatttttgtattttcagtagagacagggtttcgccatgttgcctaggctggtcttgaaatcctgggctcaagcgatcctcctgcttcagcctcccaaaggactaggattacaggcatatgccactgcgcccggccctttactttcttataatagaaatttaatggagttaatacctgtagatagatgtaaaggtattgttttagtcatctacagaaagtactaagaaagattaaaacaagtcaccatagtcttatggttgtcattggcgaaagcctgtgtttgacctgactacaacatgataatttgtaggataattctagggaatctcgtacctggcagcaatttttttttttttttttgatgtaaactcttccactaagtagaaataacagataaaattgtgagggggagggagttgttttgaagctgttgaagtttttttttaaattattattattttttatttttaacctaatgacaagcccactaaggataccattcttaatatctggtctgataagtggattaattcaaatttgtgctaagggtttgaattgatagaaataaaactctggacaattttttttagggtctagattattttgaaatccccaatagggtagtttgttatcttttggttacattttaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgaggtagaactttagctgtttactgttccttaattgactgatcaatgttttccactcactttattttcattagaaggatttacttcatgtgaatgatcccagaaaattaaactgaatatgatagaatgtttggtctttcaaatttgactcaaagtggtggtggtgtgggtatagttttttgggcattgcacaggctttgttttgggttttttggtttgtttgtttgcatttctaactatggaagtttttgatgatgtaccctgagttgatttggcactttgcatgtcttcttctgtagctgaagtacacaaagtttcaaggccagaaaatgagcaactcagaaatgataacaagagacaagtaggtaagttcttggatctaaaagtcatattctatgcttctcaacagggagaatattttaaatatatgatacataattactataaaaaaatgaaaggcgggggttgtgactgtaaaggaggagcacaggggagtgtcactgtggtgacagaacagtcctttatcttgattgtggtggtagttttgcaaatctatatatggtagaacatcatagaactatgcataaagacataccaaaaaatgagtacatgtacaaactggtgacatctgagcaaggtctgtagtttagttaattagattgtgcctgtgtcggtttcttggtttcgataatgtaccataattatataagatgtgactgttggagtttgggaagttgggtgatgggcacaagggacgactctgaactagtttttcaatttttcttttctataattactttaaaataaaaagattttttaaaattttacttttctgggcccggcacagtggctcacgcctgtaattccagcactttgggaggccggggcgggcggatcacgaggtcaggagctcgagaccagcctggctaacatggtgaaaccccgtctccactaaaaatacaaaaaattagccgggcgcagtggcgggcgcctgtagtcccagctactcaggaggctgaggcaggagaatggcgtgaactggggaggtggagcttgcagtgagccgagattgctccactgcactccagcctaggcgacagagccagactctgtctcaaaaaaaaaaaaattttacttttctggaaaaaaattctacttagtggtaggcctttttttttctgagatggagtttcactcttgttacccaggctgtagtgcagtggtgtgatctcagctcacggcagcctccgcctcccgggttcaagtaattctcctgcctcagcctccctagtagctgggattacagccgcgtgccaccatacccagctaatttttgtatttttagtagaaacagggctttgccatgttggccaggctggcctcaaactcctgaccttattttccacccacctcagcctcccgaagtattgggattataggcgtgagccaccgcacccagccaggcagttatcttttaatatgttcttgagtatttcctgctagaaggatttgttcgtttatatttacattttcctatggcttctacttttgtggtttttatgttttgtgtcagtttcaagttaggattataaaattggttttcattgttttctatgcctttgggaatggaattttcttcatgttacaagtttgaaacgtttcctcattaaaattaagcccagaggccaggcacggtggctcacacctgtaatctcagcactttgggacgccgaggcgggcaggtcacgaggtcaggagtttgagatcagcctggccatacggtgaaaccctgtctctactaaaaatagaaaaattagctgggtgtggtggcacacgcctgtagtcccagctgctcgggaggctgaggcaggagaatcacttgaacccgggaggcgaggttgtagtgagccaagatcgtaccactgcactccagcctgggcaacagagcgagagtctgtcaaaaaaaaaaaaaaaaaaaaattgagcccagatcctgtttttgaatcagttgtttaagagctgtagttttcttttatgattattgatttaataaggttttatattttctttatctgttttgtaatatataacattctaaaatcattcattttattaatattttcaaatttattaatggaaaataaattataattttacaactcttctaaattaaaaagggaatgtataatctaccttatttagaaaatgattgaaaaatgatctttcacttaattttagaaatctagatatgatatttttagatgtatatgtactcttctctacatttatatatatatatatttttatatcccccccccccgtgttttttttttttttttttttttttttgagacagagtcaacctctgtcacccaggctggagtgcagtggggcacgatctcagctcactgcaacctccaccgcccgggttcatgccattctcctgcctcaccctcctgagtagctgggactacatatgccatggaatacagaattttgtttaatttgactcattatattttaccctttttattcagaaaaagagagagctcccctcccaaaataaaataactgccatactatctttcattgcccttcaaaactcaccccaccaaagaggttcattaacagaacagtgcatattcttcccgattttttttgtagattttacagacacagacatctatacccaaaacctttttttttttttttttttttccccctggagatagaatctcgctctgtcacccaggctggagtgtagtggtgcgatctctgctcactgcagcctttgcctcccgggttcaagccattctcctgcctcagcctcctgggtaggtgggattacaggcatacgccaccacgcctggctaatgtttctgtatttttagtagagatggggtttcaccttgttggtcaggctggtctcgagctcctgacctcgtgatccgcccgccccggcctcccaaagtgctggggttacaggcgtgagccaccgcgcctggccccaaaatatttttttttaagacagaaggatcatggtgtaattctggcttgtggccgaggcatttttaatagtagaggtgaatgtttcaaacatcctacttatctagatttatgtctggatatgctgctgtggggttttgtggtttgttttctcaaacccaggcagtttgccaaacctcagcaaacagcgcaaacctatcttgttaccctgtagtcacttctcatccttgtcagtatgtgtggagcatttcacgcaattgtgatcattaaactcatactggtttctgttctgcgtttttcagttaacatcaaatattcttcctctgtttttttcttgttagtcatttttcttgtgttggatatttgggttcccacgtttttcactataaattatgctgctttgtattgctttatcatgtctcttatgattggctgaaattttactgtgttatagaggagagagaatgtgtagatacaggaaggcttgaataatatagagccatctggagagacacagtaaagatggagtaggaagtgttttgagtcagtaaggattggtgcttgtctgttttttatctgtgatgtggaaataacacctattttcttgcaatttgtgccgattagtgtttatttttcttactataaatcttggttcctgttattctttccataaaaggctttctacattttgagaacccactgtgtgtctggcacttcagtttgccggtgttggggatatagcagtaaggaaaacaaagcccctgacctcaaggagcatacattaatttagtgcagaagcctccacacttgcctggctgtatactctgtcagtaacacatgtgagtgtggactccataaatacaaatgtttagaaattttgtgtgagctattctcagtctacatattaaatattagtgaaacttaattttttattttgtataaaaaatacaaatacaataaaatatatagagagacctgtaagcatttctgttgttgactgttgaatctaaagagcacaatagcaacatctgtgctaaaccagctattacatattgaatgtcctttgtatatattctttattatcatagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaaggtaagctttgatttttcttttcagaaaataatcttatttgatctgtgaattacagatgtttctcagattaggtgtttttatgtaattcagattagctgtcttgacttttctgatatgtgcttttgttcttagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaataggtacagtttttaagctgttcttttatcttatgatattgattgaagtgtaaaatggtttcatgtaaattcacgaggtttaatgaatactaccataattgttttgttttgttttgagacagtcttactctgttactcaggctggagagcagcagtgcagtcacagctcactgtagtctcaagctcctgacctcaagcaatcctcccatctcagcctcagtaaaggggactacagttgtacaccaccccacccggctaatttttttcatttttttgtagagatgggggtctcgctatgttgcccaggctaatcgtgaactcctggcctcaagatcagcctcccaaagtactaggattacaggcgtgagccaccacacctggccataattgattttttaatgttttatttgctaaaagaaaatatatactaaagttctaaattattcattcaaaagaagaaataaccatatacttttgtttaaggatatattcatatttgaatattagcaattaaaacaagcatttaggtaatgtctaagtaggacctttttttcacccctgtatgttacagttcaaatgaagccagaaccgaagtgctaatctactttgaagtttgctggtaccataaaactgccagattgtagtaaatgtgggtccagaaaattggcaaattattgagaggttaattaaaggacccagtgtgaggaactaacagttctagaggttctcctgcccaatccaaattgtcattgtccttgtccttttcctggctgaagtttggtgccctctggtggcagttgtttgcttcaatataaacatggatggacataattctgagtcccacgattggctggatgacagcagcaataattcagatacttcttgggttacttggtatcgggtccatagattgggccaggaacataatggggacctaagggcccaccttccatctcctagcttcccaagacaaggcctccctgtctgactttaccttcttttcccttggggctgagtggaaagcgaagtcaattaccaatctcattatatctgaatttccattattttggagctgttactatgtttatcaggtgtatttgcaagaaactaatgtcagtcatgtgttcacatgaagtttaacagaatattacaggaacatattgaactcatatgccatgaacaactcgtgataacttagataagatgcttttttttttttttttttgagatggagtttcgctcttgtcacccagactgtagtgcagtggctcgatctcgactcactgcaacctccacctcccaggttcaggtgattctcctgcctcaaccccccaagtagctgggattacaggcacctgccaccatgcccagctattttttgtatttttggtagagaatgagtttcaccattttggccaggctagtctcgaactcctgacttcaggcgatccgccccctcggcctcccaaagtgctgggattacaggcgtgagccatcacgcctagccaagatgcttatttctaattagctttagtaattacttaggcttaatttgggagtagcactgcatattttggctgagggatattcttttaaacctgatatgctgaagattatttgcttttataatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatatagggtaagtgttactgttaataaattctttggggttgacatgcattttacaagactcaaaacatttttacttgtttttgttttgggtgaattgttttgaggacattagaataacttccattttgacttttcagtagaggatatacgtgattcagatgtatatataaagacattatacaaaaaaagacagtatagtatcacctttatttcatgttaacagaatatacttttaacacccaaagagtctatctaggaagcacatactcccagaatggaagggcaagctttaacatttaatagcagttaacatttatatagtatttaccaagtaacaagacattgttttaaatatttttttacatattaacttatttaaactgcacatcaactctgtgaggtaggttctattattatccccattttacaagtgaggaaatgggtatagagatattaagtaacttgcgaaaggtcacatagctagtaagtgatggtgctgggtgttgagcccagcaagttgtttcctgagtcagtactcttaatttggttttgttgaaaattcactacattttccctggttttctcctttcaccatgaaattgaaaatgtttcgatatattggccttcaggagctactgctagagaattctgtaactctgtatagtagccttatgtgtataatgtagcttttgacaggtgtctgtaaattaagtcagcatagtaactatctcagttaacagtaaactatcttagtttattgattttagaagtagtggagaggaagggctataacagaaaggaccaaaatcttgtaaagagttccacttgtaatagcaacaggcagctggaaacagaaagacctgttagcaggagttccattgcccagtacttaaaactggccattgttgagatctctctggaaagagatcagtattagtggcttttggacctgctctattaattttaatgcttttgatattgtgccatcacagccaagactgccaaaaattatactcaagtcaccagcttatgccatccagccgttggtggccttatgtagttgcgggacttctgacttgcaaaatcaccttcccagctaggagaatctgtcttaggaactccagaatagccctcgcttatcactgttactgcccttaagtttgccagtgacaccttgcttacagaattcagcagtagtattttcacaaatattttatttgccattaactcctctgcaatatttgacactgaccaaccacccaatttggggtctttcttcctagtctttaaaatactcttctaggttttcaatttatactcttcctaattttttaatactcttcattcttttttttggggggtggagggtgtcagggtcttgctgtgtcacccagactggagtgcaatggcatgatcataagtcactgcagcctcaacctcccaggctcaggcagtcctcccacctcagcctcctatgtagctgggactacaggcatgcaccaccatgcccagctaatttttaattttttttgtagacactgggtcccactctcactatgttgtccaggctggtcttgaactcctgggcttaagcgatcctctcacctcagcttcccaaagtgctgggtttataggtgtgccatggtgcttgttccatcctcccttttgtaagcctgtcctggaccctatgtgtttctgcaccgcatctctatctgcactgtttgctgtcagcttaaccttcctcagactgatctcatcatcttccttctctcctgtcatctcagctctgcctcctcccagtgttccatgttggctcatggtatactgcccaggcactagaggtatccatgattgtggcctgttgccatttattcctttgagatgtccctgtcaactaccatggtaacccaccagttgggcttcagaccttcgtctctctttaccccactttaaggcagatcagctacattttgaacaacctgtgacaactccttgttgaagaccacattgagtcagcttggtctgagaaaaagtacatttaaattagacttggatccagatgagaataatagcagtagttactagtatgacctttcagacccttggttttgacatttgtgaataaagagttgcaccatttattctgaaataacaccttttaaagatcattaaactttcagagttggaaaacatctgagaggtctgacctggttaaaacataaacctcttctgcagtatctcttataggggctgggagcttactcttcccaagggcatccatcccaccccagggatgttctaactgttacaatctcagctgggcgtggtggctcacacctataatcccagcactttgggaggctgaggtgggcggatcacctgaggtcaggagttcgagaccagcctggctaacatggtgaaaccccgtctctaccaaaaacataaaaaaaattagccgggcgtggtggcacacacctgtaatcccagctactcgggaggctgaggcaggagaatcattgaacctgggaggcagaggttgcagtgagccgagatcacgccactgtactccagcctgggcgacagagcaagactccgtctcaaaaaaaggaaaaaacaaaccttccatgcagtaactgtgtgtgctccatgtggttactaatacaaacatttttttgacaccatgtcacactgtttatcattttgagccttttgtaaaactcgtatcacatatattgcagaattgaaaatgcattgtcatagttacctccatgcatctttgtctacgctcctgtatccttgacagatagtccagcctctgcttaggtgttgccaggagtgatggactcagcgaaccctcaggcatggcccagtgtttaggaggctcagttgtgacattgtagtccctgctcttcttaattgtgtgaggatcccacttgatatatttggcctcattcctcattaccctttaacctatctgattcaagcaagctgcctcatggttatctcacatacacattgtgcttgattccaactccatccccattcatttaccaaatatacagaattcttcagatatgccaggcactatgttgagcattggtgctgaccgatgtaggcccagcccttttgatgtttacattttggtgggagacagacatagctaaaagtcaggtcccccctttcacttatcctttacagccttgcccaagttttgctctgtcttctcttccttcctacactgatttcctcctcttctgacctgtggctatctgctttctttggcacacattttaaatacactgacattccctattttttgtatttagttttgttctgcatcaccagctagatgagaacctcttggctttagtgaatatgtattctacttttctttccatgacaacactcagctcaacatggagccatagtgggcttgaagtaattgcttgtcatgttgattaggaatttgccactccagccttcagtgagaccaaaggtctgtcaatgtagctagcctttgattgttcattccagagttgaataatcctttcatctgccactagagccccgaacccagcagccctacacctcctaaatcataaaatcatttcacctggcacctttaaaggtagaaaatggtgagtgatcactgtcacataaaggagatttaccactgaagattaaacttgtatctgaaacatctaacacttcctcccagagatggacatggatgacatttctgcagccttcatgaaatgagttggctttattttttgtgctatattagcatgagtcattgtggtttgggggtaagcataaatgagcttggttgtttaatgaaaacatgggtaaagataaaatcataaagttttagaatccttaaaagaatcagccaaactagaatctctacgctaccacactcacattagatgataaggaaactaaggaccccaagaagttaattgtcatgattgaggtacaagctaacaaatccaaaactcactctcttgacttgtggcctgattttccttaagggtaatattgtaaatataggccagtgcaatggtgtacacatgtaataccagcattttgggaggccagggcaggattgcttaagcccaggaattcaaggacagcatgggcaacataaggagtccctatctctataaaaaagtttaaaaattagctggagtggtggcacatgcctgtagtcccagctactcaggaggctaaggcaggaggatcagttgaacctgggaggtcaaggctgcagtgagccatgatcgcaccactgcactccagcctgggtgacagagcgaggcctgtctcaaaaaaaaaaaagaaaagaaagaaatataaccttatggtaagtttggttgtatggtgttttccccctcccaccgcccattcttttttgaggtgagaatggaaatcaggactagcaataataatgtaaccagctcctgttttatatgctgctgtcagggaggttaagccaccatggtgggtgataaaaatcacatctgtgtttcctcagatggggttcaaagacaacaaggtgtctgaatgactcagcataatgctctctctcctctccccctttcattttctcctttctccctctcctgtccccatctctttctctttttttttttttttttttttttacctttcagaaaaccacagcttttggaccctaaaaggtctggattgatcgtactgctttctgaaaggtaaaaaaaacaaatactttgggaggtgtgaaggttggctttgtgggggacagcaggttcatcttgtagctcattgctgtcaacttatgccataccatatgtatttcagtttaataacggggtgcaaatgttttggtgttgtatacacagatgaagttaagtctcacctaggaaatgtctgtttctaacagttggggtgagaatcagcagtaaaaaccaggtatatggtagcagctggtctagaggaaaataaaagcccttggctccagccctttgtacaggcctttagtttagggtcagtctctctggaaatcttgagatttttattgcttcctcactggttactttttaaaaattccccagtcagctttctacttttcagagcttatttcagatttaagagttatccttgtaaaattgatttttaaaccattgcttcctcctggcatgaaattttggagagaaatgttatactgactgggtattttattgcttagtaaagacatcaaagacttggggattttatgaaacttgtttcaaagtatgttgacagttgtatttgatgagtttgactattgagttgagggtttaagtcctatcactgcttttaaaaaattattagggagaacaaccaaagatgaggaagtatgcctgtattttggggtggggttcaccactgcattaacctctactgactggaagatgcagtcaacaatgaggtactactgagtatggaagttatagaaggagtttcgtggaaatgagtgagacaggtttttctatgaaagtaaaagtgggggagtatatttaaagataatttaaaataaacttgagcaaagtaaaaagaaaataatacaccaataatttggaacatgagctaaatttttttttcttttttagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 519 - DNA, 57069 bp, Homo sapiens; identical to SEQ ID NO: 518

SEQ ID NO: 520 - DNA, 2396 bp, Homo sapiens
caggagtggggtcagcaggaggaactctacagctatgggagaacctgcgttcacctcttttccaagcctgcctgttctggtgagtatgggatccttattgactattgaccaaaataatgtccatttgtattcctttttctttctgtaaaacatcttcacagtttagcaagttgttctcaaaactagatgctatctcgtggaaacttataccctaggtgttaatatttgttgagtaatactcaagtaatattcaaaatattcaacaatattctaattttttgttcacggagctatctggggataatagccctgattttttaaaagtccaacaacatcactaagaaggaaaagaggtattacttggccttgcagtcttcaaattgtctctctctctggaaagttcttgaaccagaaattgcttggtccctttaaaaaaaaattttagttctctggttaaatatcatgattggttagtccttccctaaactcactgtcatgattcattgtagtgaatttctttcttttctgtttctctgtttctcctccctccatccctctctgtctctcccttcttcttcatcatggaacttaattatatctgataccctatcggaaatttgtttttagtgtgtttattatgtcttccttctcaccaagatgaaaatcaacagagtggtgatttctgcagtttacttctggatcaggggttctactgcacagcttggcacatcataagtgccctgtaactaaggagactaaataattttccctccaaaggggaacaccttgggtcgtgtaaggggtagtattaatcttaatgccaggacaacagaaatgaaatgagaaggacagaaatgaaggctttatgtttgtatctgaaacagctttatgagactagagtcttccaattgatttagagcaagaaaggatttcaaatcttaggaggggcttaatcatctttctcagtatgtcatcaaaagattctctcatggtgtaactctagttaattgagcttattagaaacagaaagcaacatggtgtttctgaggtttttcttcatgagcaggaggtgttcaggtgaaggtgggatctgggtgtggcagtgagtatttaaggtggcgagtgcaggatttctttggaaaccagagagtcaaggagctatgaaaatgacgttgtgtcctgaagcacagcagaaagagatacagagaagcgtgaggtcttggtgaacagggaagtctgggatcccggtgtcctgttggggatgggttaggaggcaccagcatctgtgtagctgacagtggcagggaagagaagagaggggtgtcctctgaggaggatgaggagggacaaggtctggaactgaccctgggtcatgaccttgagcatttagtccttgactcgcatcagcccgatgaggtcccaggacccagtgtcaatgcctggagctcctgccagcagcatcagggtcacacggagaaatgcagactctaggttccaccccagacttacttgggttcaggtccacatatctgacttcagcaaaccctgcaggtgctgaggatgtacactgccatttgagacacatttccccagaaagagaggctggtgggaagattccactgagctgagagaagccccccacagctgatcttctcctgtctccatttggttgaaatttcacattttcttttcttttgaaaggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacaggtggatgaagctcagtcttgggctttcggtccctttcttttaatgcccatcctcattcctactctgaattgtcacacttttcccttccccaccagttctttaataaaagtatttgaaaggc

SEQ ID NO: 521 - DNA, 2430 bp, Homo sapiens
tgttgcctttcaaatacttttattaaagaactggtggggaagggaaaagtgtgacaattcagagtaggaatgaggatgggcattaaaagaaagggaccgaaagcccaggactgcgcttcatctacatgtcagcatttctgcctgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggctgcgcacacgctcagcaccagccctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgtttcttttgagcttcccctttcaaaagaaaagaaaagaaaatgtgaaatttcaaccaattggagacaggagaagatcagctgtggggggcttctctcagctcagtggaatcttcccaccagcctctctttctggggaaatgtgtctcaaatggcagtgtacatcctcagcccctgcagggcttgctaaagtcagatatgtggacctgaacccaagtaagtctggggtggaccctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcctgcactcgccaccttaaatactcactgccacacccagatcccaccttcacctgaacacctcctgctcatgaagaaaaacctcagaaacaccatgttgctttctgtttctaataagctcaattaactagaggtataccatgagagaatcttttgatgacatactgagaaagatgatcaagcgcctcctaagatttgacgtcctttcttgctctaactcaattggaagactctagtctcataaagctgtttcccccacaaacctcatcagtgcactttccattttaaagcctttgtttctgtcctcctcatttcatttttcgttgtcctggcataaagattaatactaccccttacagtacccctggcataaagattaatactgacccaagatgttcccctttggagggaaaattatttagtccccttagttacggggcacttatgatgtgccaagctgtgcagtagaacccctgatccagaagtaaacttcataaatcaccactctgttgattttcatcttggtgagaaggaagacataataaacgcactaaaaacaaatttctggtggaatatcagatataagtaagttccatgatgaagaagaagggagtgacagagagggatggaaggaggagaaacagagaaacagaaaagaaattcactacaatgaatcgtgacagtgagtttagggaataagcaactcatcatgaaattttaccagagaactaattttttttgttttttgtttttttaaaaaaacggaccaagcaatttctggttcaggagctttccagagaaggagacaatttgaagactgcaaggccaaatcatacttcttccctttcctagtgatgttggatttttaaaaaaaaattcaaagctattatccccatacagtttcatgggcaaaaatgagaatactttgaacattattcaacagatattaccacctgaggtataactttccacaacatccagttttaagaacaacccactgctaactgtaaagctgtcttacagaaggaaaaaggacacatatggacattcctgtaatcaataaatatcccgtactcaccagaacaggtgggctcggaaaagaggtgaacgcaggctctcccatagccgtagagtttctcttgctgaccccac

SEQ ID NO: 522 - DNA, 2430 bp, Homo sapiens
tgttgcctttcaaatacttttattaaagaactggtggggaagggaaaagtgtgacaattcagagtaggaatgaggatgggcattaaaagaaagggaccgaaagcccaggactgcgcttcatctacatgtcagcatttctgcctgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggatgcgcacacgctcagcaccagctctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgtttcttttgagcttcccctttcaaaagaaaagaaaagaaaatgtgaaatttcaaccaattggagacaggagaagatcagctgtggggggcttctctcagctcagtggaatcttcccaccagcctctctttctggggaaatgtgtctcaaatggcagtgtacatcctcagcccctgcagggcttgctaaagtcagatatgtggacctgaacccaagtaagtctggggtggaccctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcctgcactcgccaccttaaatactcactgccacacccagatcccaccttcacctgaacacctcctgctcatgaagaaaaacctcagaaacaccatgttgctttctgtttctaataagctcaattaactagaggtataccatgagagaatcttttgatgacatactgagaaagatgatcaagcgcctcctaagatttgacgtcctttcttgctctaactcaattggaagactctagtctcataaagctgtttcccccacaaacctcatcagtgcactttccattttaaagcctttgtttctgtcctcctcatttcatttttcgttgtcctggcataaagattaatactaccccttacagtacccctggcataaagattaatactgacccaagatgttcccctttggagggaaaattatttagtccccttagttacggggcacttatgatgtgccaagctgtgcagtagaacccctgatccagaagtaaacttcataaatcaccactctgttgattttcatcttggtgagaaggaagacataataaacgcactaaaaacaaatttctggtggaatatcagatataagtaagttccatgatgaagaagaagggagtgacagagagggatggaaggaggagaaacagagaaacagaaaagaaattcactacaatgaatcgtgacagtgagtttagggaataagcaactcatcatgaaattttaccagagaactaattttttttgttttttgtttttttaaaaaaacggaccaagcaatttctggttcaggagctttccagagaaggagacaatttgaagactgcaaggccaaatcatacttcttccctttcctagtgatgttggatttttaaaaaaaaattcaaagctattatccccatacagtttcatgggcaaaaatgagaatactttgaacattattcaacagatattaccacctgaggtatcactttccacaacatccagttttaagaacaacccactgctaactgtaaagctgtcttacagaaggaaaaaggacacatatggacattcctgtaatcaataaatatcccgtactcaccagaacaggtgggctcggaaaagaggtgaacgcaggctctcccatagccgtagagtttctcttgctgaccccac

SEQ ID NO: 523 - DNA, 2429 bp, Homo sapiens
gtggggtcagcaagagaaactctacggctatgggagagcctgcgttcacctcttttccgagcccacctgttctggtgagtacgggatatttattgattacaggaatgtccatatgtgtcctttttccttctgtaagacagctttacagttagcagtgggttgttcttaaaactggatgttgtggaacgttatacctcaggtgttaatatctgttgaataatgttcaaagtattctcatttttgcccatgaaactgtatggggataatagctttgaattttttttaaaaatccaacatcactaggaaagggaagaagtatgatttggccttgcagtcttcaaattgtctccttctctggaaagctcctgaaccagaaattgcttggtccgtttttttaaaaaaacaaaaaacaaaaaaaattagttctctggtaaaatttcatgatgagttgcttattccctaaactcactgtcacgattcattgtagtgaatttcttttctgtttctctgtttctcctccttccatccctctctgtcactcccttcttcttcatcatggaacttacttatatctgatattccaccagaaatttgtttttagtgcgtttattatgtcttccttctcaccaagatgaaaatcaacagagtggtgatttatgaagtttacttctggatcaggggttctactgcacagcttggcacatcataagtgccccgtaactaaggggactaaataattttccctccaaaggggaacatcttgggtcagtattaatctttatgccaggggtactgtaaggggtagtattaatctttatgccaggacaacgaaaaatgaaatgaggaggacagaaacaaaggctttaaaatggaaagtgcactgatgaggtttgtgggggaaacagctttatgagactagagtcttccaattgagttagagcaagaaaggacgtcaaatcttaggaggcgcttgatcatctttctcagtatgtcatcaaaagattctctcatggtatacctctagttaattgagcttattagaaacagaaagcaacatggtgtttctgaggtttttcttcatgagcaggaggtgttcaggtgaaggtgggatctgggtgtggcagtgagtatttaaggtggcgagtgcaggatttctttggaaaccagagagtcaaggagctatgaaaatgacgttgtgtcctgaagcacagcagaaagagatacagagaagcgtgaggtcttggtgaacagggaagtctgggatcccggtgtcctgttggggatgggttaggaggcaccaccagcatctgtgtagctgacagtggcagggaagagaagagaggggtgtcctctgaggaggatgaggagggacaaggtctggaactgaccctgggtcatgaccttgagcatttagtccttgactcgcatcagcccgatgaggtcccaggacccagtgtcaatgcctggagctcctgccagcagcatcagggtcacacggagaaatgcagactctagggtccaccccagacttacttgggttcaggtccacatatctgactttagcaagccctgcaggggctgaggatgtacactgccatttgagacacatttccccagaaagagaggctggtgggaagattccactgagctgagagaagccccccacagctgatcttctcctgtctccagttggttgaaatttcacattttcttttcttttcttttgaaaggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacaggtgggtgaagctcagtcctgggctttcggtccctttcttttaatgcccatcctcattcctactctgaattgtcacacttttcccttccccaccagttctttaataaaagtatttgaaaggcaaca

SEQ ID NO: 524 - DNA, 44751 bp, Homo sapiens
tgatattcaatatagcatctttattaccacagaaactcatttatgtccttaatcattgtttaatataatatataagcatgtttaacacaaacatatcaaggatcgggctggaatcttttccattctatagaaaagcactaaccatccattaaagcaggtagctactttcagagcatgatatgagctgcaaaaaattgccctgacttatgccgcccccaacacaaccactcaccatatctaaaattacacccttgaagacattcattgtggttatggtagcatctaacaaagctgttcctattccagatattcggactgagaattccacaataaatttgagatacactcagttaaataaaaatgtctttactaaatctttggcaaactgatcatgtatactttgaattcctcaaaagtagatttttattttattttatttgagactgagtttcactcttgttgcccaggttggagtgcaatggcaaaatctcagctcactgcaatctccatttcctgggttcaagcaattctcctgcctcagcctcccaagtagctgggattacaggtgcaagccaccacgcccagctaattttgtatttttagtagagacagggtttcaccatgttggccaggctggtctcaaactcctgacctcaagtgatctgctcgccttggcctcccaaaatgttgggattacaggcgtgagccaccgtgcctggccaaaagtagatgttttatgttttgcttcatttgcctattttcccaagaaatctttttttcaaataccatcgagaattaatattccttgaagcaaacttctggagaatgttgaatttaggggtcaaacacaggctttctggaggtatttggtgcttgggaaaagaaacactgacctattagcaaagatagattttgtaataaattctaaataaactttatttagaattgtgaaaaatagaatcttcataatgaaggtggtctagaatttgctttcagaaactatcttcatctaatttttattaggattattttaccttgcagaattaattggtaaaatctttaggattatctattccttaaagtttttataagtatcagattttttaaacagggagttcacacacacacacacacacacacattttttgttaatctatttgggttatacggtgagttaattgtaaaacatattccttttgggggaaaaatgcaatcctacatttttacttgtactggaatgaatatacacgtttgtgcatgtgtgcatgtatagttttaccatattatgtttattatttttgagacaggttctcactctgtcacccaggctggagtgcagtggcgtgatcttggttcaccgcaacctctgcctcctgggttcaagcaattctcctgcctcaggctccccagtagcttagattacaggtgcccgccaccatgacaggctaatttttgtatttttagtagagatggggttttgctatgttggtcaggctggtctcgaactcctgacttcaagtgatccacccacctcggcctcccaaagtgctggggttacaggtgtgagccactgtgcccggcctagttttgccttataattttaaaaatctgcttgatataatctagagttgtgtctcttttatcatcattaatactctaaatgtattatctttcattttctcttccttgattataactgccaaaatctaatcactattaacattgaatcaagtctaatattctccattctcttaatttctactttctactgttacttggctgttcctttttttttttttttttttttgacagactcttgctctgttacccaggctggagtgcagtggcgcgatctcaactcaccacaaactccgcctcctggattcaagtgattctcctgccttagcctcccaagtagctgggattacaggcatgcaccaccatgcctggctaattttgtatctttaatagagatggggtttctcagtgttggtcaggctggtctcaaaatcccgacctcaggtgatccacctgccatggcctcccaaagtgctgggattacaggcatgagccaccgcacctggccacttggctgttctttacttgggttggttttattttgttgtttcctttttcttgacggaaatacttattcattccctcaacacattcatctgtgtgacaggcctggtgttgctgctgtgggtaagtgaagaagatgaagactgtatccacaaataagatttccttaccacattacagggcattaatttgtcactgaacagaactttgattatatctgacaaggttagatgtgcaggcatctcactgtcattcatttctacatagtctataattttggttttgattttaaacattttattattgaaatttcaaacacatacaaaagtagaaatattagaacaataagtctccatgaacaaaacactccacttaaattatcaacatgttgccaatttagtttccagctctctttgccaattatttcttttgctagaatattttaatccaaatgtgtctatcttcatttcatagtatgtatctcatatcatacgatcttttattttttataatcacactgacataatccctaaccaaattaatatatgtaaatatcatttaatatttagtccatgtccacacttccctcactgtctccaaaatggctttttatgttttgttcaaaccaggtccaagtaatgccaacatactgaatttagttgatatgtctctttaagtctcttttaatctgttaatggttgcccttccccttgtattttcatgctacctgttagttgaagaaatcaggtaatttgctctgtagaatttcacacattctggatctgtttggcttcttccttgtggtgccctttatagccagccctccatatgtgcagattcaaccaatctcaaatagaaaatactcaaaaaaaaacaataaaaataaaatacaataaaaataatgcaaattgaaaaatacagtataacaactatttacatagtatttacattgtgataggtataagtgatctaaagataatttaaagtatacaggaagatgtgagtaggtaatatgcaaatacatactatgccattttatacaagggacttgagcatcctcagattttaccatcagtggaggatcctggaaccaattccccatggataccaagggatgaccatatactgttcatctagtccctgtctgctttcagttcattattccagcaataaggctttgtagatggtggtgtggacttcctattgcattacgtcaggaagtgtgttgtctgatagacccatttttattaaggttaaaacagatcaaagggttcagaggtggccagtttgatagatccaccataaaaatctcgctataaaatatttcacctattagttgtagtacccattgaagatcatgttttctggacccattattccattaaggtctagaaaatggtgatttttctaatcctctaattccttctagatttattagacttcttcaaaaaagaaaaacccattcaaaaaacaaattttttttttgagacagggtctcactctgtcacccaggctggagtgcagtggcacgatctcagctcactgcaaactctgcctcttgggttcaagtgatcctcccacctcagcctgggactacaggtgtgtgccaccatgcctggctaaattttgtatttttagtacagacagggtttcaccatgttaaccaggttggtctcaaactcctggcctcaagtgatccacccaccttgtcctcccaaagtgctgggattacaggtgtgacccctgtgccaggccaaattcatttgaatttgatgaacttctggtgaccctgaaatttggttcacatgggaaaaggaaactaaatgacaatttttcctctgatttattgatttcaagaataatgagttgggctgggtgtggtggctcatacctgtaaccccagcacctttggaggccaaggagggaggatcacttgagcccagaagttcaagaccagcctgggcaacatagtgagaccctttctctaaaaaaaaaaaaaaaatttaggtggaagaatcacttgagcccaggaggaacagggtacagtgaactgtgcttgtaccactgcactccagcctgggggacaaagtgacaccctgtctcaaaaaaattatacattggtgctctagcatctttcataggttaccaaattatgcagccacaatcaagtaaactatcaaattattggtgggatcacatcaaaaactcaacttgaaacaactcctactggttgaagatatggcattttgagcatccaaaagtatactgacttatagaatgatgttttgtttctttcccacaggagttttatacacacacataaatatacacaacaatattaaattcctaggtggttaatttcttttaagccacatttttgatagtttctaattaattttaaactgtggtcagacaacagggattgtaagccttttgctttctggaattatgggaaaatcatttcctatttccctctaattcttcaacagctgtattactagtgacctcacattcatgaaattcatttttggcatgaaatttctaatgcagctcaagtgctgaagaacttcctacattcactacaatctaaattttacctagaataaattatgtttaataatttctgagaggtgacaggaggcatttctacatttattatgtctacagatcttccttttacgtgaattcactaatactaatgacaataataacaattacagataatatttacagaatacatgctatatgactgtgattcctccaagtattaactacttactccttgcaacaatcctattccacagtgtggcaggctgactctaaacaggccccccagtggtcctgtctccaggacttattcacactcttgtatcatcccgttctcttgagtgtggactatcctagtaacttacttctaccagtagaaggtgagggaatgttacttccatgattagattacacaagatggtaacttccatcttgctagcagactgtcctcccttttggcttgcatgccttgatgaagcaagcagccatgttgatgaggctattgtggccaggagctgcagtcagcgttcagccaacagccagctagaaactgagaatctcaatgcaacaggcctcacggaaatacattgggtaacaactatgttagtctggatgtggatccttccccagttgagccttcagatgagacctcagccctggctgaaatctgtagccttgcaagagaccctgaagcagaggacccaactaagtcatgcctatactcctgatccaaattataagatataattatatgttattttatgctactaagtctgtggtaatttattacgcagcaataaataactaatacatataagtactattattaccattttacaagtcagcaaaatgaggcacagaagcttagtatcttgtccaataaatcaaactggtaatcaagtggagaaagggagataatgacagataaggctaaagattttcctacattcattacattattctctcataggaatttgctgaagataaaccatgtttaaatggtgttggaaggcttttaaatcaacatattctttctctaatataaaatttattatgcttggaattgagcatgaaacacattttctcaaaaatgaattttctgatgttctgtaacatcatatacatttgaaggctttcttctattaaattccattatgaatcttctgatgctgagtaaggtgtgaatgctgtctaaaggccttcttacactccttacacttgtagggcttctcaccagtatgaattctctggtgttgagtaagaaatgaataaagtctaaaagccttaccacattccttacattcataaggtttctcaccagtgtgaatactctgatgttgggtaagttgtgagagcagtctaaaaggttttctacattccttacattcataaggtttctcaccagtgtgaatactttgatgctgagtaagttgtgagagcagtctaaaggcctttccacactcttcacattcatagggtctctcaccaatatgaatgctctggtgtgaaataagctgtgagtaactactaaaggtcttccaacattccatacattcatagggtttctcacgagtatgtattctctgatggcgaactagttgttgtcttaatctaaaagtcttcccacattccttacattcgtagggtttctcaccagtatgaatactctgatgaacagtaagttgttggcatattctaaaagcctttccacactccttacattcatagggtttctcaccaaaatgaattttctgatgtactctaaggtctggaccacatacgaaggctttcccacattccttacattcatagagcttttcagcagtatgaagtctctgatggcgtgtaaggtgtgtacactgtctaaaggtctttccacagtccttacattcatagggtttctcaccagtgtgaattctctgatgtcgagccagttgctgatgtactctaaaggcctttccacattccttacattcatagggtttttcacccgtatgaagtctctgatgttgagtaagttcttggagcactgtaaaggccttcccacactccttacattcatagggtttctcaccggtgtgaagtttgtgatgtcgaataagatgtgcacgctgtctaaaggcctgcccacattccttacacttataaggtttctcaccagtatgaattctcaggtgttgactaagtgttgagcgacgaataaaggtcttcctacactccttacactcatacaccttttctccattatgaacgatctgatactcagtaagaaaattgtgccttttgtaagtggtcattttttcagaggtaattttcacttgcccaaaatatccctcttgttgttccttttccccctcaatcttgcttttgcattcccaatcattcctaaaaatggaaccctgaaggctatagcttttaattctttccattatatcccactgaaatgaatatatttcataaatgtccttttctggagataaagtattggtcctgtatctggactccaaatctgaaagaaaacaagaaagcaaatacatactgttttcctgttccagaaagaaaaaacaaacaaacaaaaaaaccacttctatagagaaaaggcacctaaaataatgcctgttacaaattgaatggattagacagatctcaaacatagacatttctgccacaatcttatatatgtgtacctaaaaaaccttatcttctacaaaagtacacactaaaaattactgtgttcagaagaaaaataggcccggagcaggaccacttaattttttttttttctttggagatggagtctcgctctgttgcccaggctggagtgcagtagtgcgatcccggctcactgaaagctccgcctcccgggttcacgccattctcctgcctcagcctcccaagtagctgggactaccggcacctgccaccacgcccggctaatttttttttgtattttttagtagggacggggtttcaccgtgttagccaggatggtatcgatctcctgacctcgtgatccacccacctcggcctcccaaagtgctgggattacaggagtgagccactgcgcccggcgaggaccacttcattctatgcctttttttttttttttttttttttgagacacagtcttgctctgtcacccaggctggagtgcagtggcacaatctcggctcactgcaacctctgcctcctgggttcaagcaattctcctgcctcagccctcctagtagctgggattacaggcacacacccccaagcccggctaatatttttgtgtgtatttttagtagagacagggtttcaccatgttggccagactggtctcgaactcctgacctcaggtgatccgcccgcctcagccttccaaagtgctgggattacaggtgtgagccaccatgcccagccaattctatgcatctttaatcagtagaacactaacaaataaaatagttgacatctaaagggataaaccaaaagacacctcagcacttcatgtgtattaaaatgcacaaaaataaagagacaatgctagacttcaggtcctgagacactgtacatgaaaataaagcccagagccagtgaggacatcattaaggtgggagtaaggtaaagtgcagcctgtctttagataagaggccatgcaaggttgatggtatattcctctggggagggagacctgggtgcagacatttattattaattttcttaaaacgggtgaaagggctcctgataataaagcatcatgtagaaggcctttgtctttcctactgaacattataaatatacctccactaagctagctccactggactagaaaaattactcataagccaatcatctacattatacacaattcttttgccactattctgctaatgtgtaccatgggacagattgcactctcatcattttgaaaaagggaaacacagcaaataaagagtccaggagtgcaggcagggctggtgattaggaaagcaagtcaaatcagtgaagccctgttttaagtgtggataagaatcacctagagatttgtttaaactatgcagaggtgtttttaactgactgaaaccatctataggacaaagtcctgggcaagtaattgttttgttcttgtttatattcttcaagaaattattgggatgctgatcaatatttgagtctctctgtttaaatgttttcaatgctatctctttaccattataataaaatataaatacctgagcataaataataaagctgctgcttgtcaacaaatatcttctcccatttgttctctctgttcatagcatactggcctctttcaacgcacaaaatgccccacaactgttccaaataaataggactcttcacaggctgctccttctttgaggaatcctctgacactgcatggttggctggttttcattctcagcctcaaatcaaaatcacttcttcacaaaggctagtcctgctggccctatttaagtctatgcactttacgcttgtcttactccattttctgttgcttataatgaagtatctgaaaatggataatttataaagaaaaggaatgtattattattatttctactctactctgacggattaaggagtttatttcttaacaattatgggggctgagaactccaaagttgagggactgcatctggtgagagccttcttgctggtgacaaccctgcagagtcccaaggcagcgcacagaccatcaatgggtaatgggggctgagtgtgctagctcaggtgtctcttttgcttcttacgaagccatgtgtcccactcccataataactcattaatccattaagccatgaaagcccttgtgacccattcacccctcatagatcccacccattggggattaagtttcaacatgagttttggaggagacaaacattcaaaccacactctcttagcacactctttctcttttctttgtttttttgagatggagtttcttgttgcccaggctggagtgcagtggcacaatctcagctcactgcaacctctgcctcctgggttcaagtaattctcctgcctcaacctccccagtagctgggattacaggcacccaccaccaggctcggctaatttttctgtatttttagtagagacggggtttcaccatgttggccaggctggtctcgaactcctgacctcagatgatctgcccgcctcggcctcccaaagtgctgagattacagtgtgagacactgcacctggccatgcacattctttttcatatttataacactttctccaatttttgaatcatatgtttattaattttctcatattattctgttagtttagttagtctgttagttaagtgttatccttgaactacccccagggcagaaacaatctctattatcaccattaattagcaaatcccaaatacataatagatattaccagtttaattctcataattatataatcattaattaataggtatatctgcctctaatctttataccagaggtccccaacccccaggccacagaccagtccatggtctgttgggaaccgggctgcacagcagaaggtgagcagcaggtgagcgagcatgaccgcctgagctcggcctcctgtcagatcagcggtgactagattctcataggagcgtgaaccttattgtgaactgtgtatgcgagggatctaggttgcacactccttatgagaatctactgcctgattatctgaggtggaacagtttcatcccaaaaccacgtaccattttctcccgccccagtccatggaaacattgtcttccacaaaactggtccctggtgtcaaaaaggtagggactgctactttataccatattataatgatttacttatctctgctagaatttatactatgacttatcaatgctacacttactcaaacttttgttggccgggcactgtggttcacacctataatcccagcactttgggaggccgagggggcagatcacctgaggtcgggagttcgagaacagcctgacccacttggagagaaaccccatctctactaaaaatacaaaattagctgagcgttttggcaaatgcctgtaatcttagctactcgggaggctgaggcaggaaaattgcttgaatctgggaggcggaggttggggtgagccaagattgtgccattgcactccagcgtgagcaacaagagtgaaactccatctcaaacaaaacaaaacttttgttccttcatatcctccccatgtgtggtcctatccattcccatgtagccaacgcaactaaagtattttttttcaatcatgctaacattgaaaggcttatgaaatcctgagcaaaaggtcatggtaaatgtcaagtacagcagaatgactatcaaaaatggaagggcatctggggtcacctgaatgcaacagagtaaaaataaaggctatgttggatgtgggcttgaagatcatgatccagatggcgtactttcatgaagaaaatcgaaaatgctgaatgaagtaagcaaagacatgggttgagatggtataggaaaggaggagaatttttttctgtgactacagtataaatgtgtaaaactggtgaaatgacccaaagaatagtttgtgatcactgcaagacaaaataggaaaaaacaaaatcatgaaaccaaaagacatcttcacttcagattttaaaactctttcctaaatatagaacagtaatattgaaaaatacattatagagaacctatgaaatatagctacagatctcagaagaaattttatagatacatttaaattcttagagcaatagaaatgaaggaaaatatatgagtatcccacacaaaagttagaaaaagaacaacaaagtatactgaggaacaaagaatgaagaaatagattaaaatgaaagcagaatttcattaattagataacagaaatgaaagacatataaaaaatccaggttggccaggcacgatgactcatgcctgtaaacccagcactttgggaggctgaggctggaggattgcttgagcccaggagttcaagaccagtctgggcaacatggcaaaaccctatctctacaaaaaattagccaggcatggtggtgcttgcttatagtcccagctactcgaaagactgagggaaagaggatcgtctgagcccgggaggcgggcattgcaatgagccatgattatgccactgcctgggtgacagagcgacaacctgtctcaaaacaaacaaaaaacccaggttgtttggaaaacaaaaacaaaaacaaaacaaaaaaacaaaaaacaaaaacaaaatcagtggaacataaccattagctaagataataagagaaaaaggaaagcattcaaacaaaataaaaaatggccactagctattcagtgacaactccccatagagctctcactttttttttttgagacagagtcttgctctgtcgccaggctggagtgtagtgtggcgcagtctcagctcactgcaacctctgcctcccgggttcaagtgatcctcctgcctcagcctcctgagtaggtgggactacaggtgtttctaccatgcccagctaattttttgtatttttagtggaaacggggtttcaccatgttggccaggatggtcttgatctattgacctcgtgatccacctgcctcagcctcccaaagtgctgggattacaggcgtaagccactgcgcccagccgctctcacattttttgtacatcttgttggcagaagcactacctacctttgttctgggatatcttttcaagaatgtttctatactataacaaacagccttgcaaggtagagataacgtctctgtctggatcaataggcaggttcgcttgcttgttcaggataataaaggtaatgtctccttccaagctaaggctacgtacacttattgcccacgatgaatgatttgggttcttcaagctcagtgttccttttctataaggcagctcactgcatgctcaggaactatctagacccatccttatcagcctcatgtgacttgcaggcaaggaggaactgctggctgtgctgagagcaatcaaatcctttgtctttgactgagagcatgtgtttcctgccagcatccatgacactacggcaagctaacttgtcagcttgcaagtagggtgaagttgtagaaataatatagttcttgacacatgtaaataactaacaaaacagaatattttgaaaattataagggactactatgacaaccaaggctaattactaacaaagtatagaaaaagtattcaaggctgggcgcaatggctcacgtctgtaatcccagcactttgggaggccgaggagggtggattgcttgaggtcaggagttcgagaccagcctggccaatatggtgaaacctcatctctacaaaaactacaaaaattagccaggtgtgctggaaggcgcctatagtcccagttactcgggaggctggggcaggaaatgacttgaacccaggaggcagaggttgcaatgagccgagatcacgccactgcactatagcctgggtgacagagtgaggctccatctcaaaaaaaacaaagaaaagaaagaaaaagaaaaagtaatcaaagacccactccaaaaattattttgaagattatcaaaacttgagaaagcactcaattatatttaaagtggcccagaacattttataaagcctaatactccaagttatctttgagtataaaaatgaaatcaggctgtgcgcagtggctcacgcctgtcaatccagctctttgggaggccaaggcaggcagatcacctgaggtcgggagtttgagaccagcctggccaacatggtgaaactgtcatactaaaaacacaaaaattagctgggtgtggtggcacgtgcctgtaaccctagctactcgggaggctgaggcaggagaacctcttgaacccgggaggtggaggttgaggtgagccaatatcatgccactgcactccagcctgggcaacagagtgagaaaaaaaaaagtcttctttctctttgcccacacatattcccttagaaaagtcaatttctaatggctttctttggtcaccagatagtcacatagaataggcaaagcctacagaacagaaaaataagtaattgggtgccatgtaataatactacagggatttgaattaaggattgacatttcattttaaatgaaattgtgtaactggcttttaagtacattttaaaaggattgggtaggtacttgggtcgatacttctgtttgaggtgttcaagccacaaatatacaaatatatagctatcactgataaacctgggaagctgacccctttaggctaagttggccttcatgagatcagaatgcccagcacctgtgtatcagggtaacaccagctgactccttgatatagaggttctggaggatgtcttaccaggacagtcagggaagtcaggattttgtttgtttgtttggagatgaagtctcactctgtcacccaggctggagtgcagtggcacaatcttggctcactgcaacctccgcctcctggattcaagcgattctcctgcctcagcctcccaagtagctgggattacaggtatgcaccaccatgccctgctaatttttgtatttttggtagagacggtttcatcatgtttagccaggctggtcttgaactccagagtcaggatttgaccccgcctgtgctgcaaccttctgggacctcctgtaggaagtgctatacctgctttggaagaagcagctctcagaggaaataacaccaatgggttcctccccaagagatcccagaaaccagaggtggaacttaagctggcttgtattttttttatcaatgctctgactctgtatctcagtggaaaattctattcaacaagaagaggagggctgggcacagtggctcacacctgtaatcccagcactttgggaggccgaggtgggcagatcgcctgaggtcaggagttcgagaccagcctggccaacgtggtgaaaccccatctctactaaaaatacaaaaaattagccgggtgtagtgccacatgcctgtaattccagctacttgggaagctgaggcaggagaatcacttgaacccaggagaggcggaggtttcagtgagccgagattatgccattgcattccagcctgggctataagaggggaactctgtctcaaaaaaaaaaacaaaaaaaaaaaaacaaaaaaaaaaaaacaggaagaacataatttctcctctagaactaaaaaatatttgtattttatcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgatacagatttaaatagagatgaaactgtagtcaccgatcaaaaaaaagagtagcccctctctttgtcaaatcttttccccattcccctcaacagcatccttaaaattttttttattttaaaataattatagatccatgggaagttgcacaaaatgtacagaaaagtcctgtgtagacttcacccagcccctcccagtgttaacatcttaggtaagtatagcacaatattcaaaacaagaaattaatggggctgggcgcagtagctcatgcctctaatcctagcactttgggaggctgaggtggatggatcacctgaggtcaggagttcgaaaccagactggccaacatggtaaaactccctctctactaaaaatacaaaattaggtggtggcgcatgcctataatctcagctacttgagaggctgaggtaggagaatcgcataaacctgggaggcagaggttgcagtgagccgagatcccgccactgcactccagcgtgggtgacagagcgagactgtctcaaaaaaaaaaaaaagaaagaaattaatgttggtatattccatagagcttacttagacttcaccagttctatgtgcactcatgtgtgtttatttgcatagctctatgcaattttatcacaggtagcctcgcaaaaccaccaccaaaatcaagatactcacctgtaccatgactgcaagatttcctcatgttacccctttctaacccgaaccatcctctacgccctacatccctacccttggaaaccactaatttgtttttccatctctatgtgattttgcaaatattacataaataaagtcatgtagtgcataaccatttgtgattgattttgtcactcagcataatttccttgaaattcacccaagttgttgcatgtatcaagagtttattgcttactgttgctcagtttattcatggtattggtgtgcctttcaatcagttttaattgggctacttatcatttagcactgagctgtgtatatactagatactggtcccttgtcagatatgttttaccactattactctcccagtctgtgactcacccattcatctgcttattggtatattctgatgagacaaagttttcaatttggataaagtctaatgtcttaattttttatttatttattttgagacagagtcccactctgtcacccaggctggagtgcagcggtgtgatcttggctcactggaacctccacctcctgggttcaagcaattgtcctgcctcagcctcctgagtagctgggattacaggcgcatgccaagacgcccagctaatttttgtattttcagtagagatcaggtttcgccatgttggccaggctggtctcaaactcccaatatcaggcgatctgcccgccttggcctcccaaagtgctaggattacagatgtaagccactgcgcccggtctgatttttttatttttatggttattgttttcactcaagaaacctttgcctactcccaagtcataagttgggacactcatcactgtcctgtttccctctaaaaactttatgattgtagcttttatatgtaggtctaaaaaccatctcaaattaattttggtatgaggtaaaagctgagaggtttgtttatttgtttccccagttattccagtactatttgttgaaaagcctttcttctccccattggaatgctttggcatctttgtcaaacaataaatgaccctttagtgcgtgtgtggcagggtatgtttctaggacctctgttgtgttttgttcggtaatctttgccaataacatactgtcttgatcactgtagttttaataaatcctgaagtttttgttttttgtttttttttttgagataagagtctcactctgtcacccagggtggagtgcagtggtgtgatctcggctcactgcaacctccgcttcccaggttcaagagattctcatgcctcaccctccccagtagctgggattacaggcttgcaccaccatgcctggctaatttttgtatttttagtagagatagggttttaccatgttggccaggctggtcttgaactcctgacctcaggtgatccacctgcctcggccttccaaagtacagggattccaggcatgagccaccatgcccggctctgatctatctatctatctatctatctatctatctatctatctatctatcatctatctatctatctatctatctattttattttttgagatggagtcttgctctatcgtctgagctggagtgcagtggtgtgatctcggctcactgcaaactccgcctcccgggttcaaccaattctcccacctcagcctcctgactagctgggattacaggcgtgcgccactacatccagctaatgtttgtatttttagtagagacggggtttcaccatgttggccaggctggtctcgaactcctgacctcaactgatctgcctgccttggcctcccaaagtgctaggattatatgtgtgagccactgcacccggcctgattttttaatattaaccttatatcccatgaccttattgtgatttttcaattattacttcgaatagttgttgtcttgattccttaggactttctatgtacacaatcatgtcatctccaaatacagacttatgtcttcctttttgatctttatgtctcatttctttttcttttgataatggatttttatagtttataatgtattttttaaataggtgccccttaccagattgaggaagttcccttcaatttctagtttgctgagagctttttatcatgaatggatgttggattttgtcatatgctatttttacatctatgaagatgattgctatggtttgaatgtttgttgcctccaaaactcatgttgaaaattaattcctaatggcaatattgagaggtggggtttttaagaggtgactgggtcatgagggctctgctctcatgaatggatgaacctattcatggattggtgagttaatcgattaatgggttatcacaggattgggactgatgactttataagaagaagagaggcctcaactagcacatttgcatgttcagcccacttgccatttgatgccctgcaaagcctcggaattcagcagagtccccaccagcaagaaggccctcaatagacacagccctttgaggctggacttctcaacctccaaaacggtaagaaataaattccttttccttgtaaattactgaatttcaaggtattctgttataaacaacagaaagtgaactaagacaatgatcatacggtctttcattttttctgttaatatggtgaattaacaggtagaaagaaatcctaatcatcatttttgtatatcattatatttgatttgttaatattttattaaaatttttgtatctatgtatggaaaagatgggtttatgctttttttgtaatgtctttcttgggttatggtatgagttatgttggcctcataaaatgcattccttttctgaaggagtttgtataatactgctgctatttcttccttagatgtttaatagaattcaccagtgaaaccatctggggctggcattttctttgtggaaggtttctgataatgaattcaattactttagcagcataagggtattcaatttcttttttatcttgtgtcagttccggtaagttgtacttttccagaaattttaaaatttcatttaagttatcaaatttattggcataaagtaattcatggcattctcttattattcttattattcttcttttttggagtcggggtagagtctcactctgtcactcaggctggagtgcagtggcgtgatcttggctcactgcaacctccgcctcccgggttcaagtgactcttgtgtctcagcctcctgagtagctgggactacaggtgcccgccactatgcccagctaattttcgtatttttagtagagacagtgttttgctgcgttggccagactggtttggaacccctgacctcaagtgaccagcctgcctcggcctcccaaaacgctgggattaccagagtgagccaccacgcccagcctcttattattcttttaacggctataggatctaaagtgaaaatccctctttcattcctgatgttagtaatttatgttctttaaaaagagagaatgtaaattactaggtgtttaccatctttgctgatcttttcaagaaatcaatttttggctttattaattttctttatttcttttctattttgctgatttctgctcttatatttatttattttttcttctaccaggaatagttcttctctttaaagtaggatagaaatatgaaagatgagaaacagtgttgcattcaagatcaatagaaagttcctttgctagtccaggcttaaaagatcttaatttgcttcaagtcccaagccctgcctccataggccaggggctttttgaagagagaccccaacatctcaagggtgtgcctccaccctaatcagtttagctattacctgcagtagtgatttctcaatgcctgctcagccctcactcaccagggcagtatcttcttgtcccttccctcacaaccatcccaggttccttcctttcttcatccaataaggtaatcacatctggtttagaaatggaaggtcctgcttaaaagaaaaatgtgacatggaattatacaccagaaaatctttagatttagatttggttaaatttataattaactacagatcaatatggcactttataaagcctaggagcgaagaattgcaagggagttgaagaatgctcatattaaggtaacttgagggtcacaaggaatagcctgtatgaggttaaattaagtatactaaggccattatattaaccatctggtcaagaacaggccttaatataatttaacctcacacaagctctgttgaaaggcagtattgtgtagagggaagaacacagactggatccagactgcctggcttcacatcctgcctttgtttctgtgttacctagcaaattattaaccttttgtgtctacgttttctcaaataaaatgaagataataatatcttctcatagcgttgttgtgagggttaattaataatgaacaatgcttagaataatgtttaagcccaaatatatggtgatgtttattaacatatacacataatatatgtattagctattagctatttactgttatcattttgatgagtgcatactaaaaggttttttgagacattcccagatcttttctaggatattcattcaatgttaaatgccaggcttttagattttaattttcaattacaaagtaggtagaactgcatatgtctgttacaggaaacagaatgtgtttcagggttttttctgtttgagacagagtctcactctgtcacccaggctggagtgcaatggcgcgatctcaactcactgcaacctcagtctcccagcttccaggaattctcctgcctcagcctcccaagtagctgggattataggcatgcgccaccatgcctggctaatttttgtatttttagtagagatggagtttcaccatgatggccaggctggtctggagctcctgacctcaagtgatccacccgactcggcctcctaaagtgctaggattacaggcatgagccaccatgcctgaccttgaggtttttttgagatggagtctcactctgtcgcccaggctggaatgcagtggcgtgatctcagctcactgcaacctccgcctcctgggtttaagtgattctcctgcctcagtctcccgagtagctgggattacaggcacgtgccaccatgcccggctatgagttttaaataacctttctggatccatctcacactatgttctacagattcctttgatttttagagaaactcagaacccctatgtctaggtattctacttgcagatggtgtgaagcatttatgtcaattctgagctccaatataaggtgaagtctggtttcttgaacaatgcttttgccatattcaaatccatccccttggatactaaggaaatcaggaattacagagtctgaaggaagtctgaagggcatagcagactggacatgatgaaatggagaggcctagttccaacctgacaaagcttaaatcattcctttgagaatagaaagtagttttagagagtttttctaaatatagtcctgaaattgacagcagagaaagctaatatcatttgggataaataaccttacctagtgaaatgaagttgctgtagttctcccacattacatccctatataagtccctctgagcaggatccaggaattcccattcttcctgtgagaagtctatggccacatccctgaatgtcactgaaccctgaaaaaacaaactcaggtattacttgtgaaaataaattaaatacttttaaaatggaaagaggggagattgaggattgcattgcagagaggggtcagatagcatgcaaacagcattgggctgaaaacttgtgacatgagtaggggccagtaagaaaattagtatttctcaagcactgagcctacatgttcttgaatagtcctgtggctatagatatgattacattttcatccaaacatttctagaaatgagtacataacccaaaaaaatcctaattaaatgaaatagtgcacgcaagccttttgaatactatgtgcctccaccataaattctttaaaaatatgaggtcttgaggccaggtgcagtggctcatggctataataccagcactttgggaggcccagatgagaggatcatttgagcccgtaagttcaagaccagcttgatcaacattagcaagaccctgtctctacataaaaagaaatttaaaaatttaaaaatttaaaaaaaaagaaatatgaggtcttgggctctcttttccctttaatgatcatttaaaaacattgataaaaatttatcccacatgtgctacaaaatccaagaagacagattcaaattcatcacaaactcgggttttattataaacactttctcttttataaccaattctttagtaaactttcaaaaattcgttcgatggcagtctacatttttaatatattagattcttttttctttagatattttaattcaataaaatctcgaaagtcttccccaattctcaacgtctacaatatctaatctttatggatgtgaataatcttcttgcttgtcactatctatcatctcttgaacattgtttttttgttcctgagttacaggacactgaatcatgaagatatcataaagatatcacctggacaccattatcaatcatattcttttcttttcttttttttttttttttttttttgagacggagtctcgctctgtcgcccaggctggagtgcggtggcgtgatctcggctcattgcaagctccgcctcccaggttcacgccattctcctgcctcagcctcccaagtagctgggactacacgcatccgccaccacgcccggctaattttttttgtatttttagtagagacggggtttctccgcgttaattaggatggcctcgatttcctgacctcgtgatccgcccgcctcggcttcccaaagtgctgggattacaggcgtgagccaccgcgcccggccccctgtatcaatcattttcaatgaggagtcattttgctccccaaaagacatccggccatatctggagacaattttggttgtcacaatcggaggaaagggtgtgagtgttacaggcatctaatgggtagaggccagggacactgttagacatcctacaatgcacgggacggccccctacaataaaagactccccatcaaaatgtcaatagttcaggccaggtgcagtggctcaagcctgtaatcccagcactttgggaggccaaggcaggcagatcacttgaggtcaggagtttgagaccaaccttgtcaacatggtgaaaccctgtctctactaaaaacacaaaaatcagctgggtgtggtggtgggagcctgtaatctcagctactcaggaggctgacgcagtagaatcacttgaacccaggagacggaggttgcagtgagctgagatcacactactgcactccagcctaggcgacagagtaagactcggtctcaaaaaaaaaaaaaagtcaatagttccaaggttgagaaatcctgctctagaccagcacatcctgtaaaaatacacaatggacctcgttcctggcattcttctccgcaggaggaaatctccattgattgaggtatctatttgcagtcctattctgatcacatcctattcaccctgttggtgaagaagggatccctgccctaaaaagtacaagacaatcaaatagcccacactggacagatgagattgacagcaatttgttcgatgcatatattcagagcctgagagaggacatcatacatcacgcaggggcacaaggggattgcatttaagaacagcatgaacaagcaggggtatgggaggcaggctttacagtaataacaaggtgaggtgttccctggttcctgcagtggtatgtgattggcttgtttgaataattccataggctagcagggaggtgaaacccattaggttgaggacgacgaggggtgtaactggtctagctcataggagaactagctgggtaggaagcctttcccgctgggtgtgggcatatcgggtaagagcaggggaactcatggttaggcctttagggtcttgacaaagttgtcaaggcacacatgaaagtttaggccttatcttataaggcccaattacatccctacccaatccacctaaaagccttacatagtatagggtctcaacatacataaaaactaaggtcagtcaacactaaatcctatcctatatacttgaaaaactcagatctgtggagaagtttagagttttccctataagcagtcagataagaccaaattctctctttcatcaaatcacagatcttaaggaaagctcaaaatagggacctcccacttaacatcagtaatccattcctgaaaatcagacattctaacgattaaccaggtacctattttcccatcattttatttactttctttccttccttcctccttctttctttctttgctttctttcctttttctttttctttttttttttttttttttttttttttttgacagggtctcactctgttgcccaggctgttgcctaggctggagtgcagtgatgtgatcacagctcactgcaacattgaattcctggcctcaagcaatggcctcccaaaggagggattacaggcgtgagccactacacacggcctcccattatgtgaaatcagagcattataatgagttatatgtcaattccatccctccaactagctttgcacattttcctccaatatagaactatgggacacagtgggtcagtacacacacaacatctttgcttttagtattttaatcatctcttttactaaattcatttttctcatttgcttggtttctttctccacaattttcttcaatacttttccaatcttttaggaactcattttacactagacaaaaatgagggctatatgtgaagcacagtatggaaaagtgtttccaacaagaacgtgatagcgggaacggctgacactcaggatggtgctctgttacctcctcagtcactagcagcaccaggtacacacatgcccttgaatgatagttatacacatttcaaaacatctgcagatggttccattggtctaacaactgtatttgggatataacaagatttttcctggatgttatttttgttttttaaaaaaaagcattgtattggatcaggtgcggtggatcacacctataatgccaatactttgggaggctaaagtgggagaatcacttgagcccaggagtttgagttcagcttaggcaacatagtgggaccccatctctacaaaaaattttaaaaattagccaagagtggtggcacgtgcctgtagtccccagtactcaggaggctgaggtgggaggatcacctgagcctgggaggtcggggctgcagttagttgggatcataccaccgcattccggcctgggtgactgagtgagaccttctgtcaaaaaaaaaaaaaggctgggtgtcatggtggatggtggctcatgcctgtaatctcagcactttgggaggtcgaggcaggtggatcacttgaggtcaggagtttgagaccagcctggccgacatggtgaaaccccgtctctacaaaaaaaaacacaaaaaatagctgggagtggtggtgggcgcctgtaactccaggtactcagaaggctgaggcaggagaatcgcttgaacccagaaagcggaggttgcagtgagccgagatcctgccactgcactccagcctgggcgacagagcgagactctgtctcaaaaaaaaaaaattgtattgaactatatgattccacttgaacaaagttcttgttttgttttgtctttttgagatagggtctggctctgtcatccaggctggagtgcaatggtgcgatctcggttcactgtaacctccacctcccgagctctagtcattcgcccacctcagcctcctgagtagctgcgtctataggtgtgccaccatgcccagctaggttttgtattttttgtagagacacggttttgccttgttgcccgggatggtctggaactcctgagcttaagcgatctgcccacctcagcctccccaagtactgggattacaggcatgagccaccacacctgccccacttgaacaaggttccaaaaataagcaaaattacattatagtgttcgacatcaagacagtggttaccctgggcagtaggtgggtggggagtgactgaaagcatctgaggtgatttcctttcttgacctgatagcatagatgtactcaatttatgaaaattcatccagccatacacttatggtttgtatatttttttgtatatatgtcattcctccacaaaaaatttcaaaaacgttttaaaaatgtcatattgtggccaggtgcagtggctcatacctgtaatcttagcactctgggaggccgaggcaggcagatcacctgagatgaggagttcaagacaatcctgtccaacatggtgaaatcccatctctactaaaaatgcaaaaattagccaggtatggtggcgggcacctgtaatcccagctacttgggaggctgaggcaggagaattgcttgaacccagaaggtggaggttgcagtgagccgagatcatgccactgcactccagcctgggtgataagagtgaaactctgtctcaaaaaaaaaaaaaatgtcatattatgtattggggacacctattttttctatgtaaaactaagacaaaaagcactgtactgagaaaaatatactttttctggagtttaagttttaaaatgaaaagcggttccactggaagatgttaacaggaggacattctgcagagaatgccttcaattttctcaaggcatctcatttccgctttctcacagctattgacagaagattttgtaggtaggagatgctcaacattagtgggagaagagatagccacataggatactgggctatctgtcccaatcctcacaggagggaaaagaactggagtaggttcttttttttttgagatggtgtcttgctctgtcgccccagctggagtgcagtaacgcaatctcggctcactgcagcctctacctcccgggttccagcaattctcctgcctcagcctcctgggcgcctgccaccacactggctaatttttgtatttttagtagagacagggtttcaccatgttggccaggctggtctcgaactcctgacctcaagtgatccgcctgcctcggcctcccaaagtgctgggattacaggcgtgagccattgcgtccagccatggagcaggttcttggatgaagctctggtaagcaggaagtttcagaataaagaatgaatctatatacatgatacagaaattgacagtatttcgaaaaggacagagaaacattaacttacatgggccatggttttagaactgcaaaaactggtcagtccttttcaagatttctctgttggagaactatggagtcctgataagccagagctgaaagaagaaaaagaaaccatgaaataagctgcgccacagagctcccaaaatgatgtacatcataaatatgaaaacttttttctcttccattccttctcccaaactacttccattggcttttccaaagtaccacccaccactatgcccatccctatcctatacccacatataactggggaaaagtatagggagtctaaagagaaacaagctctggccgggcacggtggctctcgcctgtaatctcagcactttgggaggccaaggcagttggagcacctgaggtcgggagttcgagaccagcctgaccaacatgcagaaaccctgcctctactaaaaatacagaattagctgggcgtggtggcacatgcttgtaatcccagctactcgggaggctgaggcaggagaatcgcttgaacccaggaggcggaggttgcggtgagctgagattgcgccattacactccagcctgggcaacaagagcaaaaaagaaagaaatacaagctctgaagaaataggtgacaaatgatgaacttggtgtagaagcctagctacttctgcaagaggatttctgaccaggtcgccctctagcaatgtggatctggtccagacactggattactcagatttgttctgagcagctcctcctcactctaggacaacttttcaggactgagaagggccctgaatcctgcccctagaatcctgcctgaactacctaaacacagcaactaaaagaccacacagattgaacctggcagcttctgccaatgtgaggctacccttgccttccccagccaggaaagctcgccactccagttttccaatcagggcctcccataccatgacatccttcaccactccttctcttttattgattaatttttttttagatggaatttcactctgtcacccaggctggagtgcaatggcacgatctcagctcactgcaacctccatctcccgggttcaagtgattatcctgcctcagcctcctgagtacaggtacatgccaccacgcccagctaatttttatatttttatatttttagtagagacggggtttcgccatgttgaccaggcttgtcttgaactcctgacctcaggtgatccgcccgcctcggcctcccaaagggctgggattacaggcgtgagccaccgtgcccggccccactttccttttagtatccaagctggggacagaagggattcatgattcctgcagttggtcaacaatattcattgagaacctctatgtgttgggtacttcatacacattgtcagttgtcctcggtactgttctgcaatgtagtgctctccttttaatagctcaggaaactaatgcccaggggtcaaatcagttaagttgccaacatttgttttgaatctacatttctctaactaaaaagcccgtttcttttttctttttttggttttgttttttttgtttgtttttgcagacagagccttgttctgtcacccaggctgaactgcagtggcatgaccatggctcactgtaacctctgcctccagggttcaagcgtttctcctgcctcagtcttccaagtagctgggattacaggcgcctgccactacgcccggctaatttttatatttatagtagagacagggtttcaccatgttgcccaggctggtctcgaactcctgacctcaattgatccacccgcctcagcctcctaaaatgttgggattacaggcgtgagccaccacacccagcctaaaagccagtttctctttcaactcaggtatttgtctctgaagcaaggatttctacttcaccaggagaaatctgatcatcagcaattcactaaaaaaaagaggaataactaacagtaggttttgttttgttttgttttttcaaaaacacggtctcactctgttacccaggctggactacagtggcatgatcttggctcacagcagcctcgacctcccgggctcaagcaatcctcccacctcagattcccaagcagttgggactatagttgggcaccaccatgcccagctaataatctttcaaaaaatgctaaatctcagaagatagcaaaatagttctttccatctatggtccacctgcagaaacatcagtttgagcaattatccatcaacaaaaatgccttcacaatagctaaggcaaccaggtgagagatcgcagtactgggttgtagcacaataataagaaaagaagcattgaagagtgcaggaaggacggctcgacattacccatgtcacccctccccagctcaaggcagcacagtgtagacagaggtattgcccacttggggaaaagtcagggaagtgagcacagaactttgcctgttccctaacaccaggcccgccatagtaaaacccagcaacagggagactcccaaccccagactccaggccagtagccacagactgaccctctagacctgctctggcatcaggaaagatcatgcagcccaggcttcaggcttgcatgatgaactccatctccaggctgccaccaccatcaggctgacatcagaggccctgggctccaacagcccttagcaacaggcaagcctcagtggcctctgcaatcaggcacataacagtatggcaccagtcacagtggtctcaggctttgagcgtgccccagcactgcaccagccagagtggccctgggcttggggcatgctatgtgcaacaccagagaatgtggttccagccttttggagcatcccagcactatacccaccgtagcagccccagccttaaggaccaaaccagacaggctgcccagaaccactgcatgggctattgatgggctttcccagatgaacctcattctgcaaagactggaataaatacacagtcctttcaagtgtgcagacatcagtgcacggtcacaaagatcaacaacaatcagggaaacatgacatcgtcaataggacaacataaagtgccagtgattgactctaaagaaatggagatgtctgaactgcctgataaagaattaaaacaggctgggcacagtggctcacacttgtaatcccagcactttgggaggccgaggcaggcggatcacgaggtcaggagatcgagtccatcctggctaacacggtgaaaccccatctctactaaaaaatacaaaaaaattaggcgggcatgctggtgggtgcctgtagtccagctactcgggaggctgaggcaagagaatgccatgaacccaggaggcggagcttgaagtgagtcaaggtcgcgccactgcactccagcctgggcgacagagcgagactctgtctcaaaaaaaaggaaagaattcaaataactgttttaaggaagttcagtgaacttcaagaaatacagagaactttaaaaagtgagaaaaacaatatgtgatcagaatgagaaattaaatagattgaaataatttttaaaatcaaacataaattctggagctgaaaaatacaatgaaggaaattttgaaaatgcaagacagaacatcaacagcagaattgaccaagcagaggaatgaatctgtaaacctgaagacaagttatctaaaaatatacagttggatggaaaaaaggatgaaaagaaatgcagaaagtttataggattcatgggacagcatcaaaatagcaaatatttgagcagtaggagttaaaaagggagaagagaaagataaacaagtagaaagcttatttaaagaaataacagcaggcacagaggctcatgcctataatcccagcactttgggaggccaaggtgggattacttgagtccaggagtttgaaaccagcctgggcaacatagcgagactcatctctacaaataattttttaaaaataagccaggtattgttgcatgtgcctgtagttccagctacatgggcggctgaagcagaaggatcacttggacccagaagttcaaggttgcagtgagctatgatcatgccactacactccagcctgggcaacagagtgagatgaaaggaaaggaagggagataagaaggaaggagggatggagggagggagggagggaaggagggaaggaaggaaggaaggagaaagaaagaaaaaagagaggaaagaaagaaaaagaagaaaggaagggagggaggtagggaggaaaggaggaaggaaggaaggaagaaaggaaggaaggaaggaaggaaaaaagaaagaggaaagagaaaaaaagagtagcaaaaaactttccaaacctggggaaaggtaagtatccaggtatggcccaaagttagaaggaagaaaataataaagattagggcagaaataaatgacacagaccagaaagccaatagaaagaatcaataaaattaagagttttttttttgaaaaaagaaaaaacccacaaaattgacaaacctaactaagctatactaaccaagagaaaacagaaaatattgaaaatattcaaataaaactagaaatgaaaaaggagacattacaactgatacaacagaaatagaagagactattatgaacaaacatacaccagaaaattggataacctaaaataaatgattaattccctgacacatacaacctaccaagattgaattatgaagaaataaaaaatctgaacaggctgggcatggtggctcatgcctgtaaccccaacattttgggaagccagtcattatgacaaacagtatggagaggcctcaaaaaactaaaaatagaactaccatatgatctagcaatcacactactgtatatatccaaaggaaatgaaatcagaatgtcaaagagatctctgcactttcatgtttattatagcattattcacgatggccaacacatggtgtccatcaatggatgaatggacaaagaaaatctgctatgtaaataaaatgtaataccattcagctatgataaagaaacaaaacctgtcatttgtgacaacacagatgaatctggaaggacgttatgttaagtgaaataagccagaaacagaaagataaacaccacgtgatctcattcataagtggaatcttaaaaagttgatctcgaccaggcgtggtggctcacgcctgtaatcccagcactttgggaggccgaggcgggaggatcacctgaggtcgggagttcaagaccagccttaccaacatggagaaaccctgtctctactaaaaatacaaaattagccgggcatggtagcacacgcctgtaatcccagttactcaggaggctgaggcaagataatcacttgaacccgggaggcggaggttgtggtgagccgagatggcgtcattgcactccagcctgggcaacaagagcaaaactccgtctcaaaaaaaaaaaacaaaaaaacaaccaaacaaacaaacaaacaaaaacaacttaatctcatagaagtagagagtagaatggtagttaccagaatctggggtagttgggggtggggggaaatggcaaggttgaggagatgttggtcaaacgatacaaaatttcagttacataggaggaataagttcaagagatctattatacaacatggtgatatagttaacaatatattgtattactgaaaaaagctaagacctgtaaagtgttctcaccacaaaaatggtaactatgtaaaaggtaattcatatgttaattagctagatttagacattccacaatgtatatatactttaaaacaccatgatgtacatgataaatacatgtaattttatctgtcaaaaaataattttaatactaaagctcggtattaagaaaatgaccagcctgggcaacatagtgagaccttgtctctacaaaaaaattttaaaaattagccgggcatggtagcgtgcacctgtagtctcagctaccaggaggttgaagcaggaggatggcttgagcctgggaagcagaggttgcagtgagctgagatgatgccactgcactcaagcctgggcaacagagtaagaccccatctcaaaaaaaaaaaaaaagaaaaaaatgaaagaaaaaagaacagaaaaaaatgaaagaaaaaagaaaagaaaaaaatgaaagttaaagcaaacaaaatgtacctttttacaatgactgcattgcaagacctaaaagactgatgatgccctatagtagcaaggttgtggggacaccgacactaggtcggtccacatttagagctatgtgaagcagcatttcaatcctgtaaactctgaatcagaagctccacttctgacactaaagggactgtatctgtacataaagattatgcagagctatggccggggcagtggctcacacctgtaatcccagcactttgggaggccaagacaggcggatcacctgaggtcaggagttcaagaccagcctggccaacatggtgaaaccctctctctacaaaaatacaaaaattagccgggcatgatggcaggtgcctgtaatcccagctactcgggaggctggggcagaagaatcgcttgaacccaggagacggaggttgcaatgagccgatgtcgtgccgttgcactccagcctgggtgacagagggagactctgtctcaaaaaaaaaaaaaaaaaagaaaagaaaaaagattatgcagagctatgctgacagcatggtttataatgaattaatggattaaagttgaaaagaacctaatttcggaatgattcaataacctgttgtttatccataccattgaaaatgatgcaaccattaaaaatgatgttgccttaattttgaatgggtgaagccagtgtgttaaaaaaagaaaataccagcatgtgtagtgtgaaactattttgacagaaaaaaaaatcatgtttccctagcaggaccagttaaaatgtttacagtcacagccagcaacacgcaccaccacattaaacagagtgtgagcctgaaatacccaaatacttcaaataagactttcccggctcaagttctttcagtcttccttttaactgagaaaaaaagctaaggatactgtaaaaacagatgctgttttttctgagtggcttttttttttacttcggcttctcattcatgaaccaactctatgatttaatttgcccatgtgtgttggagtacggcctagaaaagaatggcaaaaagtctctgactgatgtcttctaagcactgaaggcagccccatgctgcttcctttcacatcttcctgataaacaggtttattttgcttctgaaccagttcttttggctaagatgcctatgaagccctccagcagatgttgggtctccttgaccaactggtctcactttgcatataacatcattaaaataaaaactgtaaggcatacatctgtatgaaacccagttacctccataaagaccctgtagcttcagtataatctggacaaaacttgacagtgtgtgccatcatgagattgatatctcttcccttcatcgtgagattgctgaataaagcaggaaggaatttttttttttttttttttttgagacaaggtcttgctttgccacccaggctggagtgcagtagcacgatctcggctcaccacaacttccacctcctgggttcaagcgattctcctgcctcagcctcccgagtagctgggattacaggcgcatgccaccacacccagctaatttttgtattttcttttttttttttttttgagacggagtcgtgcccaggctggagtgcagtggtgcgacctcggctcactgcaagctccgcctcccgggttcacgccattctcctgcctcagcctcccgagtagctgggactacaggtgcccgccaccatgcccgggtaattttttgtatttttagtagagatggggtttcaccgtgttagccaggatggtctcgatctcctgacctcgtgatctgcccgcctcggcctcccaaagtgctgggattacaggcgtgagccaccgcgccccgcctaatttttgtattttcagtagagatggggtttcgccattttggccaggttggtcttaaactcctgacctcgggtaatgcacctgccttggcctcccaaagtgctgagattacagacatgagccaccgcgcccggccagatttttttttttaagtatgcataatgatgatatttggtatactgttgtaattaccaatatatgcttttatttttctgcatgatattagacaggttactttccagttccccatatgaaatggtgagaactacagtttctacctgaaaggattgttatgagaaataaataagatactacatataaggcacttagagtagtaaataagcatttcataaaagtcagctatattaataaagatgaagaatactacatatgcttcttcccacaattatttttaaaattctactcaggcctgtaatcccagcactttgggaggccaacacaggcggatcacttagatcaggagttcaagaccagcctggccaacatagtgaaaccccatctctactaaaaatataaaaattagccaggcatggtgatgcatgcctgtaaccccagctacttgggaggctgaggtaggagaatggtttgaacctggggcgggtggctgcagtgagccaagatcgtgccaccgcactccagcctgggtgacagagcaaaactctgtctcaaaaaaaaagaaaaaaaaaaaattcttcgcagccctgctcttgataggcaatccttcttgattatcaacaatttacaaaaggagggtacaaagataaaacaaatgtggtaggataccaatttttggatctgggtgatgaggaaaaatattaaattacaacctaacggtaacaaatctactgtgcacttattatgtgccaagcattagctaagggttttgcatatattaattcctctactcagagccatcctatatagcagggtctatcattatcctcattttgcagatgatgaaactgtggcacaaagagattaaataaattgccccaagctcaggcagctttaagtggcaggttgaggactagaacccccctactttagctccataacccatacgactgtcactgtactaaactgcatctcatgagacctgataaatacgtggcctgaaacactcatgctgtcaaaaacttcaagccactttccaaatttctactgtcttcccttcccttctaataaccccttcccttgttaacacagacctctccactaaaaaccccatcgtattgtcactccttaaaagcctcaaaagcagaaaagatcctgtcgccaatcaaaccacctcctttccctgcttttgaactcagggcggtggggatcaaagagacctagtgggtaattccatctaaactgtaaactcctcaactaatcaccatcgaatgaaagttctacgtggtggctcacgcctgtaatctcaacactttgggaggctgaggtggaagaattccttgactccaggagttcaagatcagcctgtgcaacataaggagacctcatttctacaaaaaaatttaaaaattgcgcgtgggaccacgtgcctgtggtctcagctactcaagaggctgaggtggaaggatcgcttgagccagggaggtccaggctgcagggagcgagatcacttcactgcactccagcctgagggacagagtgagaccctgtctctaaaaaaaaaaaaaaaacttaagtaacaaaataaagctctgcagttagcttctcttcaggaggtttacttccagaccatccaaatgattagaaagaggcagctcataagagaaactaaattactgccaaatgctcatgtcaatacctactggaggccgggtgcggtggctcatccctgtagttctagctacttggcaggctgaagcaggagaatcctgcttgaacccgggaggcggaggtttcagtgagcacatcgtgccactgcactccagcctgggtaacagacccagactccatctcaaaaaatacaaaaaaaaacaaaacaaaacaaacctactggaaaggggtaggaattggaatctaccttcatcaccccatcattcactgggaaggaaggccaaagcaccaggtcagtggacaggacatttcaggggttaaagtctaactagctgaagattaactggaacaagcccgcatagtctgacaaaatcatatctattgactggcagaaagggagaaaattccacaggaagggttggaatagaatggacgagagagacgagaaaagctctttcgtaaacggttgagttccagctgaaagattctaaggaggatctaatgacagctgcaatctggaatggctgctgtttccgaggtgagattaggagaggcagggattaatgagatattgaatgcaatcatgagtgtaatcaagagggtatccccagtaataaaatgaaaacagcaaagcaagtctagaacatcactggtaagaaaactgtaatctctcaaagagggagtcattatgccattttacaactactgcaccacctggggagaaatcatgttttctattaattttgcaactggctttatctgtctcttccttcctagcctgattaatgacagagctgcttcattgttcagtccgagctgattttcattccacagaagaggaaagcaaatgcccccacgcccagaaaaaataaaaattacacttcatggaacaaaacggaaacacaaactcatctggatgttgacttgtctatatgcaacagcaatcatttcctcctctccccgctgccttcctaaagaacagcaggattgggaaaggagacgggaatcttgagaccgcgggcctttcctggagccggccttggctgagcaggacacacccccgctagcgcacttgctccctccgtctactgcgcgcaaaacccgatggaaataacagggagcctggaataaagctgaccctttcccgtatcagagcgaaaggccaggtacacgaagacggggctgggatctgtctccgagttccccgcagtttccatgggagggagctcgggtaaagctgtgcaatctgcagttcttcagactgcgtctttttgtttgggggccttcattcactccggggttcctgtatctaactcggagccattccgggccgctggacctgggcggctctgaagcgagaaggcagaggacgcaacagggcacccggcgcccagtcagcgccacaaactccacagctactgcctcctggctcacactgaggtctgcgccgcccccgcgccacccccgcgcccattgcctcggtgcaagcgaccaactcacctctcggagccgacaccagcagcgaagccggaaagaactgc

SEQ ID NO: 525 - DNA, 577594 bp, Homo sapiens
gctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggtaatgtgcgcgcgcacacacatacatacacaaacgttccaactcaacacaaacaaaaagatattgagagatagtatcctgatacaatgagtaggtggtggacatctaaaacgtataccttatccataggtatggagatacatcgtgtccgtttatacaatttattgacagactgtgacacagagaggggtgtgtatttacatgtgtattttcaattcagtcagtaggatctatagtgctacggatgtaaatacttactgaatgcagtcaactgcagggctcagaaggtagctcctctgtgctatgtcaacttacgaatctgctgatttgagcagtgtagaaagtttgagtggcacgttataatgtgcttttgtaaagtcatcagttgagattagtttaataatgctactgttactttgtgagaaaaactcaaagattttccctcaaatcattggcaaaaggaaagttataggtagtgaaaacttgattatatctaatgctcaactatgcacattctttaaggggaagtaagagaattctttatggaaatctgagttggataatttattgtataatatacaaatatattaacatgcaattaacgtgattgctttttaacttagtaaactattcaatttagttactattcagtttattcacattctttttataaaataatttcatccagattatatgagttaaatacattattaattcatttcttggtacatgctattatgttttaaggctccaaatatgtttcaagaaaatgtgtgtgaatgtgtatgtgtgtgtaatttatatatatatataataaatatatatataataaatatatatataataaatatatatatatattagttttggactactagtgactaagtatccaaacttaaagaccaacttttgaggtttcatataaaaaacagtatttaagtctgtatgatatcaagagggaaaactgaaattgcccaactttaatttttttatgtttgatattttccatcatggtttaatgcttctttagcatgaattattcaaaactgcaacatattataaaagcctttgattattaataaatgctatatgtaatttacatgagaaatctaagatcagaaagtacaggtgcccagagatatcactaggattcctcatgacaaactattccttcacatgcttttatgtactataaaaagtgggttgttgcaactgctccccccaacaactgtatacagtactgagtcagaactgttagatggaaaatactgtttgtataagtacttaacaattaaactcacagggttagcaggcacttgcagagttctagtttaataaagcccacattcagtccctctaagtagcaggtctgaatctttcccatttctaaagattctcagaattggagttcctgcagtctcagcaaaccactttaatgtttaacaactcacagtgccaggagaatctttcttacagccaacttaaatcctttaaattcttctttaagtctatttcatctagaaaacatacaatgttctgcctttctcacaggtattatttttcaacgctttggtaatctccgtgcctgtctcccttgccctccttttggttatggaaaactaaattgggtagggcattgtactgtttgtgccttaagacttctcagtataaagggagaattgcttcataatcttacacggtttagttctattcaagttggttagactatggtgttcatcttcccaaatctgtagggcttgcagaagaatttctgttacatggtcaaaaagtgtcctttctctcccactttggtcagtcatctcccaagagcctgactgacactatagagactggatgtgtgaatgtggatgggagaagacagcccattgaccacatggctgtgctggttgaccagggttcaccaggtactccccaccctcagggcactatttttattcactgctgggctggtttttactaaagtacaaattaatttactttgttatctaggatctacactttgactcactggaaggttctctccaatatttatttacacatttggatgtacttaaattacatatgcatcatttaaaaatatctaaattaaatgatatatgtactttctcaacactatttgatttacttggtcttcttttacattttattatggaatttgcatggctttttcaatatttgaatagtttctcatgtgagctgggcactgtatgaaaatttgtgtttattcattctctatcattggcaggtggttgagatgagtcttccaacaagttgaggtcctcttcccattacataacacttagcctttctccctaaggtgaagtggatcactaccttctggaccttagacccttacacacttgaaaactttcctaatctagataaatgtgtgtttgccttccttactaattaattgcaaaatatgaaactgtaaactgtggttatagatctttttttaattcagcaatacacattccccagttattttcaggttgacataactttattgatttttttcctttagtataaatgttaaactcagagatccataaaatacattcatctatttccttaaaaaaacatagctactctgactttttttttttttcaaatttagtgccaggaatgacctaaaattgacctttacatcaatgactttaattatttccactcactgaaactcagtttatttagtatagagatattcttagttgacttaactaactttcactaagatttccaatacttcaactttggtctttgccctttttatccaagtgtctctcctattacttttgctccacatttttctgttttattagaactgtttgcatgtagaacatggtcttaatattcaataaaacaattattggttaagactactttctacctctgctacagaaaggagaaagctacaatccctttttgacataataaggatttcttcttttgtagttctgatattatggatatctgatatctggatattatggataaaacatttcactttcctatagacataattcttcaattatataggtaaagtagttgtgtacatttatgttcaaatcacatgtctgtaaaatccaaacatgcaattttaagctaaaagtaaaaaagaatgattatatttatttcaaaggatttaatttagaaaacatgttgaatcattatatggaattgttgtaataaattcttaatgagttatttgagaaataaagcattttacccccaaacagtttttgcagatcagtaaactgaaaatcccagagtgaaattcagcttctatcttcaaagtgaaaacatggtaatgtcttttatctattgcatctttcttctttttagagactgtgtgtgaaaaaatagcatactgctttttaaacctaattaaaatgggaataattgagtagagatagtttatactactttaaatccagggacatattaaagaaagtaaaaaaaaaaaagaaaaatgagagaggattttatggtgcttaatgataaaagtctctatttttagaaactgtgcattttctaaattctaccacaatttatacctatccccgactctatctaaactctaaaataatatgactacatgatgactttaaaaatcattatgagatacacatatatacattatagacagaaaaatagatagatagatagatagatagatacacattgctatctgtgctcaagccaaagaagttttttatatattatgttatatagtcttctaccatcaaatatattaatggtaaaactttgttttaataattgggagcacttaggggacccagcaagccagtccacatgggctgctctgaaaagttggctgctcaatttaataattaaatttaataacttaatcagtaattaagctattcattgagaacatagtctatagattaattcagtgttcatgaacttctaagttctatcaccatgtttgaattcaataaaacaaatagcttctatgtaataagaaaaatatatttgacttgacttttagttatgtgatctgaaatagcatctcaagtttatattcgaatgtagtgccgttaatagtgagactatcattcgggatacctattgattacatgttaataataatggtagatatatattttatctgtggtacatatttagcttattattactcttttgaagtttagataaggttatatttcttaagaagtgcttattcctgggagcaccatagttagacatcctggaatatctttttctgggaatgcctattgtcttaatgcattgggtataaaggaaattttggggattgtcatcaaagtgaaaaatcagggtcgctgaatgttttatgttatcttatcttaagttgtatagctgattaaattggctaataggaggatgtggaatataaacaaacaagcattttaaatggaccaacaatctgctacagaattctcttgataaattacaaatgtatatctataaatgaaagaagttctagaagagatgaactaccttgaagatacatccatccatccagagaacttcttaaatgaggaaatgagtgcagttaaacccttgtcctttttttctaatgcctataatatctgactgtgtatattttcattatgcctaataaatacacattaaagactttcaaaattgctcttaaagtgatgcacttttcaagtgcaaaatataattatgaagacatgccctcctgtagagaagtcacctgcatcctcttcttgaattcatgaatgcataatactacctttcatgttggaattttcagacgttttcaataaagacgacttagttacaattcttataatacatgttctcttttttatgtcaagtatcatataaagcaacctcctttcttgtaattgcctttacagccatttcttctttcccctaactgatttcaataactttttagttagcacctatgctagttggtaccttccagaacctaaacaaatttgtgtttatttgacttcagaaagtttccatattaagaagacttaaataggtatttgagcgctataattttggcttttattagattacactacatttatttcataattgaaattagagggctcatataccttgattagtttcttttagatatatgactaaaatgaactctctgttttaggtttctgctccataatttggaactaaaataaaaatgaaacattttggtatcatgggtaggctaaatgtgcatgacatttaacatagaacttaactatttgtgacttaaaagaaaacataatgttagttgtaactgtgaaatttttgctgtataaagtgtatgcactaaaatacgtatttttatgtgttaagtaataacagagcttgaaatgccagttggttttaggctgtgttggaagcagacagcaagaacaataatatatatctcaaataactatcaagtgcctttcagtgtgaagttgattttttcaagatacacattgtcataattctttggtatatatgaacatattttgtataaaataatttgaataaaaattgaaataaaaatgctactttgcttgaaaatgcctttgggttataacaaatgtagtttttcataaaaattcaagtagcccttataaaatgacagctgaaaaagccttttgtagattgatttcacaaatcaggtttacttagagaataagatctggagagagaaattaaatatttgatatgttttcaagaaaaagtgtagttatagtgataatagtgatataccaatttccaagttacgtagtctctcttgttttggaagtactaaacttggaaggaaattctggaaaaataaattactttctaccttagacagcattttcagttgtagctaagacactctaaacttaattgaagataaaaaaacacaaaagagtattatggtgtttaaattggagcaggacctgtaatcccagcactttgggaggctgaggtgtgaggatcccttgaagccagagcttgaagccaggtgttctagaccaggttgggcaacaaagcaagaccacatttctataaaagaaaaaaatcagctgggctcagtggctcatacctatagtcgtagccacttggaaggctgaggaaggaggacagcttgagcccaggagctggaggctgcagtgaaccataataaggccacttcactgcagcccccaggcaacaaagggaaaccttgtctcaaaaataaataaataaaacataaaagggggttttgatttgctttttaaaatattcgctaatgatattaattttcctgagatgacactcagataacatgtattcaactaatctcttattttgttcaaatttgatatctaaattctaaacatatacttctgaagaactgataatatatttttctcttcacagaaaaggataaccatatagttgaatcattttcttttcttctttggctgggaggaagagacaaatctgtggcttagcaaagggataggaattgatgttggccttaaaagcaacatgatatacccttctctgctcatctcctgttcctagtccagctctgattctatttccaatgactctcgttatttttacatttatattttgctgttttaatgtacaaagtttctttcacatgacttagatctgttgtgaaaacaagttgggttgtaaatcaataataaaatattgaatgtccaaattaaggatgctactcaggattttgtactggacagcaatgagaatgattcatagagattattcagtttgttcatttctagcaagtataattaggactgccagttttctttttttctttgacaattggcaatttccttttggcaaattttatttcacttttgtgtgggtgtaagaggcagaatatagcttattttgaaatggatattgccagttttttcttttcttaaacaatcttcttcctctctattcttcttgccatcagtccttattcatttcattcacataattatcaagtttttcagcatctttttttggttcacacataaatgttggcatatacttctaactccagagatactagccctcgcaaatggtaagaactactctattctgtgcgctctttcacccaaccttacaagtttctcccctgttcaccatccacacgtaactttcatctttagttcagaatttacagctttccccatatctccattcagaacccacctaccagtgttcttcccctgcccttcttcccacagctattactcagcacttcacttgtcctgtgtacttctcagcaccagacaaatacagtcagcttcccctctttccactcacatatgtcccttccagttctttattttgctgtgaataattatgttctctaacgtcttccttggcaagcaaaggctatatgcattttctttttgtgaatgaaataaatgccatattccaaacaaaaatggccatggggcctctttttttaaatgacagggaggatagaggcatgccttaaattagacttgtcctattcatttgcttcatctgatatgaaaggaagaggcatggaggtggccatattacttgcattcacattctctaaaaacgttcaaaatccttgaataatattttaagtgtaggtgcatgatccagccttcacctacattttcagctttcactgtgtatccgtccacatgattctactattgtccacttatactgaagagttcttgactatgacatgttcgcagatgtttctgccattgcagacgctgttccctctaccccaaaaattttttacccttcatttgttgggccatatcttgtatattcttacagacttaactaaggagttcagtcctgcatttcctttcacaggtcaagtgcatctcttatagcctgccattacatccatcaattgccatcacatccattgaaatccttggggtaagtctgctgtcatccttatgtctgcaaatattctgccttattttactcaataaatatctgtagaatgaatgaacggaggtgtgaataaaaatgaatgatgaacaatatattattagattcttcatcattcaggacattcccactgatacatttgacaatagtgtagctggtatgaggaatattggaaatttccacctagtcattgacttcaatgtttagcttatgatttaaaaaccacttaaacttaatgaattactgtgaatacctcttctgcaatttcactgcaagaagcctccagaaaattggggctagctctacagtttagctatatatttatattgaaattagtgaaatttaaggaaatcttaagtacatatttaggcattaagaacattaactcacaaatatttggctaggcgcagtggctcacgcctttaatcctagcactttgggaggcccaggtgggcagattgcctgggctcaggagtttgagatcaacctgggcaagatggcaaaacccatctctactaaaaatacaaaaagttagctcggcatggtggcacgagcctgtaattccagctactcaggaggctgaggccggagaatcgcttgaaactgggaggcagaagttgccatgagccgagatagcaccactgcactccagcctgggtggcagagtgagactctgtctcagaaaacaaacaaacaaaacttacaaatactgatttttatgtgttcagtttctatgatatattatacctaaatgtatttctctctttgggtattacttctggccactgatagagggacaatattacatgaggatcaaaaatgaaggccctggagttaaacctcctattttcgaattctagttttgccattgactagtaattttataacttctcttaacttcagttttaacttcttcacagtgggaaacaatggttcctaatatggtgttttgagcctagtgcttgacattcattgagtgttcagtaaacattaacagtgattattactcagattgtgtgtgttgatatgtgtgcatgcgtatatacacctgatgttgtagtgggggaaaacttccaacaagttttatcaaactccaattgggataattatccttgtcttagttaatttaatgatttcaatagaaaataaatagatttcaatggaaatttaattagtataaatatgttcccttttgtcctggtggtaggtccacaaagaagatttttccatagagaattttttccccagttataattttttagaatgcagactattctactgatggattaagtggtcactgttttcatggcaatttttatcactttaagatctaccaagatcatttggtcaattgctttaggtataatttagtgtcacttatcaatccaaattgcagagtgctttattctatgtagcatttcagaacatcttttgctgaaggccacaagaaactgaagactggtatatataaattggtgtaatttgtacatgagttagttaagccgtattttttcattggtggcatatttaacagcttctgataaatgaattacaagttaggaacttgatcatttctttcctatttaggagtttataggaggtacataagaagaaggaaaaatagtgttttgtaatctttttcttttttttgaaagagagacaataattccctgaccaacgaccactgcagcctttgagatagcaacatcctggaaaagccacagtgtggttgtatcataattgttaagaatctccaattgcctgagtttatcagtcacatacttttcagcaaggttttgttagcaattgtcccttctcaggccagttaggatgggaccacagtatgtaagagaagcttggtcttcttctaaataataaattttatctaaaatatttagtcatctagggtagacatacagaaagaaagtaatactcttaggagtgaagagaatctgtttatttttatggtcagtttcttaatccaaataaactttttatcagttgttaatagatagttaaattctttgccttatttatagaatataaacattggaaagacccttagcaatctagattcttttaccaatctatatacttaaatatatcactatggtaggcagattaatgatatccccaaagatgtttatatttgagtccccaaaacctacaaatccaatatcttacatgacaaaagggactttccggttatgattgaattaaagaggatgagatgattatcctggatcacacagtggggtccaacttaatcacaagggtcataagagggaggcatgaatgtcagagagaaagctttgaggatgctatgcttctaggtctgaagttagaggaagaagtcacaagccagggaatgcaagtgacttcttgaatctggaaagggcaagtaaatggattctcccatagaggctcaagaaaaatcacagccttactaacatgttgatttgtgcccagtggagcttctgacctagaggactataagataataaattgatgttgcattaagccagtaagactgttaattcaacctcactcaaccttaacatggatgaatatttccaatggtgtgggagctctctgcttatcaaggtgatttcttctcctgtgagatgagtgaattaatgccagtctcctgtctctgcgcaaatgtcccttcctccttctttcttttactcactggacttcagtatgcctttttgaagcaagagtgtagggaaacaagaagagctctctgttcaacataatatccctttaaatattcagagacagctggtaaatttcattgttaagacataaaagggactgaaacatttgtgagaacaaagaacatcctatgcaatgtatatcacttgcattatttccttataagttgaaatttatgcaattcgaaatgctttactacacattttaatgtagtgcaggtttgaaatataacatactgatagttcttatattcttgataaggtggtaaactcagtacaacactatcatatattaaaaatactgttcacatttttaaatattgcctactttacccagatgtttccctgtcataccatctacatcctgtatccagagggtaaacagaaaaatcaaatcattttaaggggatattttaaggctttctcttttggttttttactcttctgcttacagatttgtgaattcctagggaaaaaagcattagttttaaataaaatgtgatgtatgaattgaagtaatagctataatttcataaaataaaaaaattctattctagacatagtggcatataaatggaaacttatttttaatttttgtattaaagaataaaataatatataaattatcactaatcatatgtgtacagctttttgatgccacgaatgtgaacagagaacagtataggccctggaagttttattttaaaaattaatattaaaaggaattttagtaaagaacacacagatttgcagctcaattgacagcaaactattgaaataaagccctcatttctgggtgtggataggtaactgcacaacgtctctgttgcttcacttttctgtttcactttgactggccaaagcaaacttactaaccacttgaaacaattaaataagagaatactgattaggcacaaatgaatggatttatgctaataaaacatatatattatatgaagagtgacatctgtgaaggatttcattatcttttccttaatattacatgccaattttcaaagatctgatcatcatgtagatttagaactgttttgcaagtggttaggaatggccctctgttgagttttcattacttgagaggagatatgaattatgtatttaatggcaagacagcaataaatgattaaaggaaagaaacctgtagcttggacttctcacaaaaatgaaatttatgtgaaaataatatgtaaactttactacaaaagttgttatacttccacaagcatgcatgaagataaaatacaaatttttgtcactatggaagcagggttattgccaagaagattgtagataaagcccaaacaatgctgatttaaatgaatttaaatagatttaaagaattgatcatgtattttaaactacgtttaatgttcttctttcagtattcatgtgctacatactatacgtttaggaagtgtgtataatatccctgggagaatccttggtgaccaccactgatgatttgctttcctgtcatcattgaaagaagatttgtgaaattgtgttacaaaaaaaccataaatcttctttatgtgtttcttccaatagtaggtcactttactgtggatttgttgttgtttttatatatcacactctgtttaaatctctatgatcatcaggatgcattccacccctgaagtgacagggcaaaccggtcttccacagggaatagagaaggtgagaaagcacagttaaagagaaatgataattggcctaaaatattcataaggagtggacttgggtggatttacatagtacataagcatccctaagtctgaaggtcttagaagtagaccaaatacatagtaactggaatacaacatgtgatctgattgtatgacaaatttgggtacatgaagttctaaattcttcattaagtcatgaatattaagctagccctaggatttaatttctgatcttgttgagtgctgtttcatgaggcaaggaaagaactgcaaactcaaaatttcttactcccgtgtttggaaacaactcagtaatacttgaccagtgtatttcaggtggtggttgctttatttttaaagctatgatatcctttgttcaaaggaaattctaggagccaggcaaaatagtcataagcagaactactttatttaaaggtggggggaaggtcttgaatggtgaaagcttcttccttttcctctgtatctgggcaggaaaggtgcttttggcataagcccagaatactttgatctgaataacacttagatggaccatgaacaggaagcagctgctgtttctaaaacatggttaaaattcatacatcttacctggagtaattaaattagctatctgatacactgccaattaattccacctctaagtgttgattatatattagtttcattctgtttgcagtttttatgaaaaatgttaaagtgactttgggagctcagccctcaggaactactgagtgggtaaattcaagaaagcacaagaaattttcccctgagctaagtgctcaagtaggaggggaggcccactttaaagagtaaagcaggaattagcagtatgtgtagcagaaacctggatatagaactaacatctggaagaagccaaagagttctagaattaaaaacaaaaatatttcaactggggagtccaagtcattcattcattctgtcagtcagtcaatcaatcatacattcaacaagtattttttaagagtatattgtctgtcagacacttgctggccatgtagcaaaactgaaagataaatcacattgtgggaagagcagatatgttttacataaaccaaataatactgggaagtaacactacttggataaatgactgtattaggtcattcttgtattgctataaagaaatacctgagactgggttatgtataaagaaaacagatttaattggctcacggttctgcaggctttacaggtagcatggtgctggcatctgcttggcttctggggaggttttaggaagcttacaatcatggtggaaggtaaagtgggagcctgcatgtcatatggccagaacaggggcaagaaaggggggtgagggagatgccactctcttttaaatgatcggatcacctgagaactcatatcatgaggacagcacaaagccatgagggatccgccccagtgatctgaacacctctcaccaggccccacttccagtactggaaattacaattcaacatgagatttgggtggggacaaatatccaaactgtatcagtgaccaaactcctttggataaaacagaaaaaagaaaaaagtgaggtaaggggcatctgaaatggatggactgagatagttatctctgttgtcatgggtcagttgactcatgcacaaagcacttaggtcagagtttaaaattaatttagatctatacaattctaaatttttatctagagacttttcaattttgctcttttgttttttaagtttttttttttttttttttaattttgaaacttcggccacctccaagtgacgaaggggattacagcaattgaaaggctcctgttaatcctcttagtttggttgtggggtgcagcctatgggccagtaccaaaagtgtgatcagctagaggctgaggggatgttctagatgtaagactgagaggaaagaaagcaatagagcactagattggacctggtctagtgtgaggtccagagtacctctttttcattgggtatctgtgtgtaagagaagcacagttggcccctgtccatagtgaaggtactgtttctactctatggaggattctctgttcctagtggtcaatgccagacatttcaatttagatgctgctaaatgaaaatatacattagaggtatctattcatcctactaagtatttattcttcaatgtgaataaaggatctggaaacaattctgttaatctaatacctcaggtgttggatctctgaaagaaaatgtgggaaaccactgaagagaataatgagagctgaagatgagtgttattgtaaggttctgctttgatggggtaggtttaggggcctctaaattgtagagaccacaaaaaggaagctcctaatagaaaaatgaggacttaaaggaaagggcactggatggaagagctctgtgctgttctttgtggaagaccctgtcaccaaagttcccagtgaaaagctctcagggggattatggctatgccttgaggctgggtggaattcagatagtaagttttcacaaacattttggggtccttactacatactgggtactgttacaggtaccggtgatagtgaagtcaacacaacagacatgctgtctgtgttagtggagactaaggaagataggcaacaaacagatttttatttcttaatgccttatataaaaatgtataagaatttaaaattcttgtgaagataagtaactgattctaaagaagaataaacagggtgaccctacctagtcctagaattgggtaagacttcccagagtaaatgatgcctaatctgagacatgaagaatgaggaggagctattttggcatagagctctgagtcaggacccaaggaatggttctttggaggttggctcagaggccgaggggcaacaagaaagcaaaggctgataggtgaggaacaaccatgcaggaccctgtaggccctgtaacaaggaaataagaaaatcatctcaagtagatagatatatggcctttaatccaactacagaactaaacgtgatcattccatagtcccaacagaagcttttctacttcttctcagtcatgccaaatgagataggtaaccatgacttttttgttgttgtttttattatttggaacaaaaatcagaaataatttataaacaagaaaataggagttccaaagttgagtcatcactaatttaattacatgtgcagtaaattcaggatccattcctgtgtatagctctataaagttaattttcagttcttctcttcttataagagtcaacagacgaggcaactctcctcattcctgaaaagcatgtatgaccactgaaatatgagccctttccagtgttgcttggtgacaaagcttgtctctttctatatttatttaaaatttgaaaataaaattgtgatgtgtgtagggctttgtggtatagtttatatatgtaagttgccttgattcatgcatttctgcatgttgtccctccaattttaaggtgggaacatggaaattttcccttctttgtactaagtacagagaggtgcttacaggtattgattttagagttggactgagctggtttgaccttctattccagctctgaccagctgtgtgactacttcaccattatcaggctcaggttgttcacttgtggtgttacttgtcttatagggcctttgcaggcagtgaatgagctaattaatgttgagggcttaacacagggtcttgcacaatagtaagtgtacaatgaaaggagctgatgattactttgatcacagttggcttattctgttaaaaacaggttttcatgactccttaaaatgttctcagtagtgacggggaacttaaaattgttgtatcaaattgttgaaattgttgctcttctggatggccctatcagatcacattatactgtagttggtttttattgggaagagaagttcaggcatgagggccagttagcatcatgttgagcacaactattgcaaatagcagccctgtgttttcacaactctcataataaaaaaatgttcagtgtgtgccctactttcctggtacagctttaattcaagataatgatacatttgtagtggcttttctatttctcgtggtgttttgtttttttttttttttttttttcagagcaaattgagttaagtagaccagttgttttcatgaacttgctgccaagtggaaggattttttctctcttttctataaggctagatatttaatctaaaactactgtctctgtgctgggaagcatccaacctcattactgtttaaatgtcttactgtctttggaaattctgatgaaccccaattagtaacccataaacccccccccccaccctgttcacttcgttatttaaaataaggaaatattagtgcaaaaacatttgtatcagtgtctagtcaggataacagaaattattctcagcttttcaaacagaggtaatccaataccaagtaattgtttaccgatgtgttaaaaagcctgagggagagaaaagagttagttgctattacccagaattagtaattgcaggaagtcactattgcccctagagctggaagggcaaaggggaaagtggtataagcagtattatgtggaccttacaagcatgtacctgggagtgctgcagctgctgctgaaaccacctgacctttgctttgcaggcatccatgagcccacagtcctgctggtgctactggactcactgacaaggtgagcgactggtgcctacaaccactggctgctgccataatgatgctggtattgcagagaggcaaccactggcctggtgctgattctgccaccgccaaaactcatgagcgctaagatgctaaggcagttggacacagaagcagaagaaaattaatcatggcttcttttcttctcctaacttccactctcccaccagtcctttcctttggaagacccaaccagagaccagctagcaaggggatctggaataggtactttactggcttcaagccagcagtttacaggcatgcagtcccagagtaaagttgaaagagtgagaatagagctgaatgctatcagacaaatacccagcactgtatttagaccatttaatataagattgcagaaactggccgggtgcagtggctcacgcctgtaataccagcactttgggaggctaaggtgggtggatcacttaaggtcaggaattcgagatcagcctggcctggccaacatggtgaaaccccatctctactaaaaatataaaaattagccaggtgtggtggcatgtgtctgtaatcccagctactctggaggctgagggacgagaataatttgagacccagaggcagaggttgcagtgagccgagatcacaccactgcactccagcatgggtgacagagtgagactccatctaaaaaaaaaaaaaaaaaaaaattgcagaaactgagaggaagtggcattaactaatgaaggaaattattttctgaatatatatgtatatatctgttatacagaaatctaaagaatgggtacaaatatttatattcaactcacacctcatgtattagtttcccactgctactgtaatgaactaccacacatttagtgaaaaaaataacataagtttattattttgccattctgtgggtcagtgtcactaggctataatcaagttataggtaaagctgccctgctttctacaggtattctctcaaaagagaattcattttaatgttttttttccagcttctagatagaagttccctacattcttaggctcattgcaacctatctccattttcaagctagaaacttcctctcatgctgccatctttatgattctctgtattgggaaaaactctttgctttaaataactcatggttcgatcgggcccacttggataagccaggatactcttcccatgtcaaggtctttagttttaatcccatctataaagtctcttttgacatgcaagacagcactcacaggtcctgatcgtggacatctatgaagatcattattctgcttactatatctcagaattttagactcctatacatctgtagttattcactggctattgttttccttagaaatctcaaacatgtaatctttaaaacaaaattactcttccaacaaatattcttcccccttggttggggacattgtcttcatctagcagcctaggcttgaagcttgagaatatttttctgtagtccctcattagattgggaaatctgctaattttcattcctaaatatatctccaatctacccctaccctgcacttctcttaccactcctatatcctgccaaggaaggcaggcattaccctgaaagtacttcttgattaatggtgcctagcattgtactagctggtggagccgccgatatgcataaggtatccatgttgtctgctccaatggaatgtgcagtctagcatggaaagtgcacattaaacaaataaatctgtggtaaatgtccatttctgatctttctgctcatggctccccagttccattttcaaaaattggggttttaaaatttctgaatattctaaagagaggacaatttgtgttatttaaaagtaatcaaagtaagtactttttgtgcatgtgtgtcacttttccctgattctgagatataaagatggcaaaaaagactactaaatgacatgtcaagtatggcaatttaattttaataaaatccagctagaatggctttagggctcatctccatcaattgttgtttaaatgagattaagttgaagattttaggcccccacactagacttaatgaatcagaatgtctggagtagggcctgggctatgcattttaaacaagtattccatgaattttttgtgcccattgacattatgaaattattgaaccaatgtcaactcatgaataatccctggatttataacactgaggccagaggatgaggaaggtttcatggctggctcactgtctgttctctcctttttccgctagtaactcctgtgaatattctctgtgaagcttccatggtgactaaatatctccctagtgcccagttcacaatcagagtaacatgcaggaagcactcactatatgccagacatacggtgctaaagtcagcctttcacgtgttgtcatatttaatccttaacacaaccttaagctggagacactgttatctttcatttgcagattaaagatcgaactttaacttcacattttactacattgcatggaagagtgctggggcttcattccagggctttcaaattacaaagctcaaatgtgaaactacttctctgagaattgactattattccctctctgtgccaccatgaaaattttcatattcttttattacagaataatggcatttaaattgttgattcacatatctgttctcctttcttcgattcccccagcaataggatcagtgtcttctttatccaagtaaatgatagccctaaggtgctacagggtctatgcgttagaagatactcaaaaaactgtccaactggtcattcattcattcaatctcagctgatttagagtgggtcaaaatgtaaatattaagtaaaagtaaaatttgggtatatacataatcaacaaaattaaaagataaaacttatatgaaaaggtgtgcaacatcactgatcatcagagaaatgcaaatcaaaactacaataagatgtcatctcactccagttaaaatggcttatatccaaaagacagggaatacaaaatactggtgaggatgtggagaaaagggaacccttgtacactgctggtgggaatgtaaattagtacattcactaaaaagaaaagtttggaggttcctcaaaaaactaaaaattagagacatactcatatcttcagcagttaatttgtatgtataatgaactgatattcagactttttttaagtaagaaattaatggtaaatacttttttgtcttttttttttttttttttttgagagaggatctcactctgtcactcaggagggagtgcagtggcatgagcatggctcattgcagccttgacctcccaggactcaggtgatcctcccacctgagcctcctgagtagctgggactacaggtgcaccactatgcctggctaatttttgattttttgtagagaaagggttccaccatattgcccacactggtctcaaacacctgggctcaagcgatccgcccacttcagcctcccaaaatgctaggattacaggcataagccactgcatgtggcctaatggtaaagactctaattgacaattacaaaaaactataaagacgctttctgagaacccaaagacatcaaaagtgtgtaaattcaaaagtgaagcaaatacttttcaacaattttatctcacgtaaactgcaaataatgatataatttgaaatctcttatctttcttcacaggaagaaataaaaatgtgtattttgcttcccttatcattatgcacttttacttattttataatgtactaattctgttcatgggtatgaatattaaaatctaatttatacatcaggcaacaaggcacagtagtattattatctcattcttttaggcacatgtagttaagcaacacatttcttgttagaaacacataatggaaacaaaaccccataaaagcgacacaagtctattttaatcttagaatttgagttctttaaaaaacaataaaaattccttcgtatgtatattaagccatttaattgaaagagtggagtaattttctgatattcacattattattgaagaatataagaagggtttccataatgcatactaatagaagttaattaaatgatcagggtctggttatctgaattggcattcaagcgtttattgaagtgtagctcatgttcttcctgaggatattaagagcagcagcagaagcctgcttaaggacttaccctgggctttgacttgctaaaacatgttctagagtatcttcagcctactgactccttgttgtagagacattatatatcagcagcttgactaattggtctaacattcttgaggtcacccagggctactggtcagaattcaaaactttttatgtccttgtcacaaagttgatcatcataactgcattatggaaagtgtgggccagcagactatatgccaaacacagcttaattcaataaacatttatggagttgctgataattttcttatatcatttattttatttaatatttctgtactcattcaatttacaaaatgctgagacccagaggctaaacaaactactcaaagtcacagttagtgagtgaaaaatctgagatttgaacacagatcctcaaatatgaaacctgggattctttctgccatgtgtgagtaggttcctttgaaaatatcctcaggttactcaggctcttattagcttcaagagacaaaaacccccgcgacactttacctgacttaagcataaaagaattaattgattgagaggactcaggggtagaaaatgtctccaggccttggccaagatgggaaaggaaattgggagctgaggtgactcattgtttatagtctatttccaaatatctcatctctgcttcttactttagtttcataatttgctgccttataaaagggctttctacaccaatttgtaagtagtgactatcccagcttttgtgtgagtgcgtgtgtgtgtgtgtgtgtgtgtgtgtgtgtgtgttgtgtaatagggcaagagaggagagaaaaagagattgggttggggaggagagggtgacagggtcacacatctgtatctcactcagggaactatggaaagatacactctgagaaaagtccatgggcagctctatcagaaggagatcagaggagggacagggaggacataattaatagaaataatctgcattatttatgcaaagcctttctcgtacagcactgttaaacactgatagttaaccccctggttcttccacttgattaggagccattttatgaatcttaattggtttctttatttcaatttagttatatatatacatatatgtatatacgtgcacatgtatttatatacactaatatctccacctctatataattatatttcaaatatgcaaatgtatgtaattttatttacacaggcattttatttccattaattaactaggagtctccttcatcaaagagatattttgatgcttcttgtagaaacacacagtgggaaaacattgccttattgtcatttataaagtaattacttatgtttatgcaaccatcacttggttaatattagcagggagaacaaggtagtgtgagaaataagaaatggtgcttctgtgagtagaacttgcttagctatggttttccagctcctctgatatggtacagtattctgtgtaaatatctttagcagcaagcatgggtgagtggtcttcctaagaatcatcgcacaaataagcatttgtgtacaagaggactcttgggggaagcatcatacttatttcaacttaatattatgtgagatcactaaacatttcttcagttacagaatcactggcacttctgcaaaaaggccaaacgtgcaaatgtcaaactgataattaccttccctttatgtggtaaaaggaatatagaaactgtggaaatcatctcattaaaaggtaatattgagtaccttcataaaaatcatcctggttaaaaataattcaaaactttgtctcttacagtttattattcagctccctcaccccataagtcaacccactaagcacgtggctaaagtgccagacttataaatacttgaagtttttgcatgtcgtttgtgctttgtgagattgtagaaagtaacagtaatgtgtggattttgggaaaaattctatacccaaaataaggcagtagaagtgtagtcctgatttcaaggggagaatgagaaagatggggactacctctagcttccacactcctattgattagtgctgtgactttgggcgcatctctacatgcttcattttcctcactgagacactgggctggaatagacagtattagaagttcccttagtgtgatgtcttcatccataatatcttagaggtatgatagtcatatttcttaaaaaatagtacattttgaaaagagatgctgatcattgtcgaaggtgagtgatgggtaaataggtttgttatactactgtcttcacttttgtgaataaaaatgttcagagaaacagggaaagagaaacatagctgcagagaatcgttacaataatatgggaatggtaaaagagtagattgaacttccttgcatcttccatcctaaaaaacatgatacgttagtttattctaagaagttactgcaacataaaatgtgatataaacggtagaacatagtaggaaatgggaacagagaagttggaaaaatttccaaggccccttgggtcattttggttgaaatgctttatcattttgttatgaatgtcatataagacatattcatagtcaagtttaatgaatatacatttaatgaatatacattacaagtttcatgaatataattaatgaatatacattacagagataaatggttcatgaattcaccatcattttggatcatgcattattgctctttaaagtcattagtttggaaaagtgagatttgattataatttgtgacttgctagcatgccctaactgggcaaaaaaagaagtgacctggataagggccaaatttcagagcaaaatttataaatacaatgtggctgatccataaagtatatagaacacaggagacaatctgcaattaactgtaaaagtttgaccatggaaatagcagtgtattaacccaaggcttgagctgtaacattagagcttgcacatattctaaactcactttctgcacagcttagtttcttctagagattagtgcaattatttatctaaacaaatgtttattaagaagacaacatgctgttcctgagctgtgtacatagtcactcggggacctttaaagtccaggattattatacactgccattcaaaactggatagagcccttttaccctggggccacaattggacattgaatctcacatgaaaggacagaaccaacctcactggaaaccagaataaagaggtgatcttccttttaccaaaaactttagaatcctaaaagtgacctttatatttttaaatatactccgcacattcactgccaacggccaagcttttggaaatactgtctatacttgtttcctcaccagactctcgctcctcaacccaccaaatcctgcttctgcctctgccactttgcataggtcaccctctccaagtcaccagtgaccttcttgttattaaacttacttttacatttctttgttacttgactttgaggcagaaattgatgttgttgagtattctcctctttagggaatgttcttttctttctctgcttttctttttctgcttcttggcaatttaaattatgttatcttagatttctttgtagatggctctttttattttccgtaggcatttctcaagatttagaatgaggctttcttctctgcttattctatatatttgtgtgggtaatagatagcaccattcctgaagtctcagtcattatccagaaattgatttacaaatcttcatgttcttgacagatctacctatgagctttgaggaaatacatcaaactctgtattggacagtataacgttgatgattctcagacacctcaaattcggcatgttcaaaacgacaaacctcatctcactccctgtgaaacccaaactgttgctcctccaatattcttgatcttagggaatggcatcttcacctgcctggtacttcatcctagactctttcctcttcttaacattctattttcagacaaataccaaggtattggacacgtctcttgattctttccacctctttctattcagtaaaggacactataggagtctgtttttgtacagacttctattatctctttcctagattgttgtaatagcctcttctcttaaggtgtatctatacagtctcgttacctagttctcatccgatctgtttcccacaattcagagtggtccttctataatgcataactaaccatagtatttctctcataaaaataaaactgctttccatttctattaagataaggtcatgatacttctttattccgctttaaatgtttgcataatctggccccataccttgctatccagcctcatctcttatgactcccctttgtacttgaggccctgccttgtagaaattctttcagttctcccaacacagtatgcttcttcttgccttcagattttagaatatccctctgctagaatacatacatatatagataagtacataaaatctcctctgccaggaacattcccctcctactccttgacttttaattggcttacttctatttaactttcagaaatccctgtgtctttgttctcttagaggcattcctgatcctctaaattaggtgaagttaggaaaccattgtaacttgtatatccaggatgacaacacttattataattgtttaatttccttttatatgtctggggtgaagggagaaagatcctgcatgctctctaaggtagaaattatgcttattttgcttatgattgtacccctgctgatgcttggcaaagtgcctgacactgtttttcagctcatccttgctgaataactaaatgcagagagaaaataaaatgtaatatttgtcatatactcccagtaccatttgagagaaatagtgggcaagctatttcaatatagtaccaaaggacaccttggcacctaaattttaattgcaaatagagtagatgctataccagtgaatttggggagagctatagagagccctttatgtgtttgtgtcttccatagtccctaggatatgactctgcatataatgggcaatcaataaataattcttggattaatgtttgaatgacttttatttgactaaaggaagaaattaagctcaataagcactgctgattttttttctctttactgaatgcagatataagattaaggggagatgtaggagatttcaggctaagaataatctttgggctaattcctcttttagcttaatttattttaatttatcaaactgcttttattctgtttttctttcctaggagttcctcacttatatcagaaaatactgttagtgcctagctatttcaacaaagaataaaatttaatataatttatatgacctacacctcatctaaagatagcaatactggagatatccaaccaggaaggagcaatttttgcttgataattccaacaaaaattgtttgatttccatttcaataatgaaaatattgataatggcctgtttatgagattgcataacacttttgataaaagtaaaattaaccttatggaataattcttacagatattttaaatgattcctttttgtgataagacactaaatatacaaatgaaaaaaggccatggcaattgtttacaagttgctggcaggaagatgagtgtgcacacaaacatggcagcagaatttctagaatgtggttgagtaccatgtacagtgaggacagaaaaaagttccttgagtttgccagtcttcacagaggacataatttgattgctaagcagaattttgctaagagaagtgaggaagggtgatagaagcaaagagcatggaaaaattagggaactgttagagaacaaagtgtgagaaaagactatgagaaaggagaaagagacaagagaaaaccataaggtgaatctgggtagcaaagtaagcatggatcagagaatcaaggctttgcagattatttattatagaattttgctttttatcctgaaggtgaaatggaatccattgaataattttgatcaggggaataatatttattgagtgctgactatactcaaattactgtgaatttacctgttaaccaaatagtgaactctgtgagtaagtgtttatgcacacttctttaaagatgttccttctcattgagtttaaaggccttattactaggagtttacatatatatatgtgacagatgaatctgagaatattacttaaaagatgaggtttgcacagttttgttgcagtgaatttaactgtttcaaactgtgaattctgtaatgaagtgtttaaacgttcttcaaagatgtcaccatatgatgggaactttacaccattgttttatgggttaacaccaataactaatcgtaaaatacagatcctgttatcactctcattgtgcagatgaggaaactgaggtacagaaaggtaaagaaacaaattacacttctaaaaagttgtagaacccggtttcagttcagcaatttgacaccagagtggctctcttgattaaaccttctgctatactgtctttatgtttgatagaaacatgacataactgagaagagagagtaggaagaagaaattggagtgaggaaaatgcctaagcagggcacagaaacaagatcagacaatgggaacactgtggaaaacagatgaggattggattgattggctgtcaatcataaaaagaaagaaaggaatctaggataatttttgaatttctgacttagcagccgtttggagagtggttcattttatagcaacaaagagggtatagggaggggtaggttgaaggaatgtggcggcagggaatgatgcattcatctagtgcatgtggaggtgcagatgcctgtggggttccagtgggacttcttgagaaggccctgcatgaggactggaggccaggtggaatttggtgtagtagtgaagaaaacatgtagaattaaatccagaacccctaatcatggcaacaaggccctacatagtgtaaccctggccactgtcaccaacctcactcccctcttgcttccagtactctggtctctctggtattccttctgtccttcaacacaccaagcttgctcctcccccagagcctttacacttgttgttctgtcatatagaatgttctgaccgttaccaccccacctcttttcattcagatctcagtttgagaaggcttcactgaccaccgaatgtaaaccagacccattagttactgtcaacattatgacttttttcatagcacatgaaaccatctgaagtcattttctctatttgtttatttgttttttgtttcctcttccagagtatatgctcactggaaacactggccttgtcttttttaccattgtatcttcagggtgtaggcaggaatgcaaacaacatagttgtataacacatatttgttaaatgaattaatgaagatacaaacatgtatttgaagtcattatctcttagatgggagttgaggtcatggcattaattagaatgaattagagaagtgtgcaactagagtgatcagggaaagagaagaatgccttgacaacactattattctcttcatatcctctttaaggataaatggtaatcttttcaactgaaattacaggtgaactaattctataaatattcacattcagttaaaaatggtttctttttcatttgaaatttatatctacttatgcttaaataaaatatatttggtctaaattgtatggaaaatctcttttacatttctgcctatatagaaacatactagcaaaagtattttaataaatccaaagtccaaccattgttagaaattaacaactaaacaaataaccaaaataaaatgtatcaaagttggtctttcaaaaatataagaaaacacagaaatggtaataagaactagtttttttgtatagcaactcaacatgaggccagctaatataaaatttttctcagatattataaactgtccataccaataaaaagttctaaactaatgagaaaaagtgagtagacaggcataatttgcttaaagttacttacttgtagaggaataaaggtctgcataattaatgtggtgaagttaataatcacaagaccctaaatgggagaatactgttatcttgcttttattgttactgttgttacactgttataccagtatactgttacatttccttttaccattggcaaaacaccttaatgtctttaggtctcagaatctttatctgtggaataagaggagtcaaacagatatttgaaaggtactttttgggttctctctgtatgctcttaaaatctatgcactgtttttactacatacatcctgtccacaggtaatcaggaaatttaagtaactgaccacaagggggagaactttaattctgcattaaattatttaatacaatatgaaatgatttgaaagtacttggctatgtgaggttggtgataggctgcttcatttccacttccttgtggaagttggggcattctactgctaacgataggtttaacttaattgaaatgtggttttgtgtttgtagagttatgatacagtcactggatgtcaaattctatttgtattaagcaataatgctccatgaagggatccagatgccttttttattaaatttatgatagtagaatgttagaattcaccctggaagagtttttcctttcaagtaatattatttaagttattctgcaagaaatctattaccttcttgaatgtcaactctgaaacaagcataggattatcaacggggcagtctgtactcaagtattcatataaaaagaaaagaattagaatggtgctggccacatcatttgaatgttatgtgatcattggctttatatatatgttcgctgttatatgaatattaaatattatatgttcacactgttaaatattcatttttctgtgggttaagttatgtactcttatttaaaattttattttaaggcaactatagctttctttatttttaaaatattttatttgaagttccaggtacaagtgcaggacgtgcagattttttacgtaggtaaatgtatgccatggtggtttgctgcacctgtcttcccatcccttaggtatcaagccccacgtgcattagctatttaccctgatgctctccctccccttgcacccctgacaggccctagtgggtgttgtttccctccttgtgtctatgtgttctcaatgttcagctcccatttataagtgagaacatgaggtatttggttttctgttcctgcattagtctgctaaggataatgccctcccttctccatccatgtccctgcaaaggacatgatcttgttcctttttctgtatagtatatattcatagtattccatatcacatatcacatatacatatatcacattttctttatccagtctatcactgatgggcatttgagttgattccatgtctttgctattgtgaatagggctgcaatgaacatacgcgtgcatgtatctgcattctattataactttcattgagttaagaattaccttatcagtcatactaaggcttaaaagtttacattttggatttcattaagctaaatttgtaaggtataaatgtaagatttctggattttatcaaatgtacccaaacatacacagctaaatgagtccaatttaaagacattatatcagtgacctatataagtatctcaataactcatttgttactgaagacaatttgtacttccccttagaagcattgtcacgctctttttaatatgttcagtgacagcagatctgtctttgagagtgagtataaattaaaaaaattctatcaatggagatcaaatcttaaagttactaattaagttggagtataacaataatttggagatcaaaaattagatataattaaaatatttaagctccctttgatttataaacctcctttattcaactgccaaagggtcccaaaatgttttcagcaatggtgttgctacctggacaaatataaatcttcctgaagtgactcctatacggggtaaatttatttgaatacattcattctgatgtgttcacaaaaatgaacaaataactatataaatgaaattgtttatagtcacactgtgtttattttccagttattttcatagtgagccttcatgaattctttaaaattacgatatgctaagtaaatcagcaattttatcgttgagagatattctataacttcttccaaaaatgattaagattgttaataattctctttttggcttagtgaattaggtttctattggtattctcacaccaaaaagtattatagacccataaaaaatctatgccaggcagtgtgttgaatataccccctattgctacttgtacacccagtgactagcacagtgattggcctactagtacatttttaccagtagctatccaataaattttggtacataaattaatgaataataagtgatacaaagagcttatacacgtatatattatttttcccattacatatgtattatttttccacagtgctgcgtaatcattcacccaaaccttagtggttaaataaacaataatcactaatgttcacagaactctgatttgggcaggactcagtggaaacagctcatttcttctccacacaatgtcaactgagctggcttcccaggtttactggaagcctggggtctggggtcacctgaagtctcactcactcacatgtctagtggatgataggggctgttggctgcgaccttagctggggatgttgtctgaaattgctggattgctcacagcatagtgtttgaattccaggagctagcattcaagtgagcaaggcaaagtgcacatttttatgacctagccttcgagatcacacggaataacttcttttgtattttatcggttaaggcagtcacagaagaggtctgcctgcattcaaggggagagagttagaagccactacacaatgggaggaatatcaagctcatgttgtaagaaaggcatgtgggattggatatattgcagtaaccatttctggaaaatacaatatgccatattttctgatttataaatatataatttttatccaaaattcaaacttctattcactagataactttagaaaataatattcccaaacaaaattcaccctgctaaaggaattctatctgatccaataaacatttattatccattattctcttacatatgctcgtcttctctcccaaaccactttcacattcatgctaatcctggaccaaggattgtatctttgttgaacgttttctctattccttttttgctgggaaaatatttacttacgtttccagtcagtttatcactaatcatttactattgacatgcccctgtgtctttttcacagttcaaagaatagacagcataatgctgtttaatattaggtgtttttttctaaattgatataaattttgaaagttatatactctttcttagctagaagaattctcattttatcttaaacatttttttctgttactaacttgaaagaaacttcagttaaaactgaaaaataccattctaattaatgaagtattacaaaatttggaaaatagaatggtcttccctaaaatttgattctgttatgtaacaatgatgcatatcatttttgtttattatatacattttgtttgttacatacaatttggtcagtattttcatatgcagaacaaaattttcttcaaatgaaaaattgaggtgcacactgagattggtttgtcctcaaagaagctaaaaatgaaaaaaaaataataaaaaataaaactataatgataagtattttctccattaactccaaagttggtttcgtaagatgttaaggtgatttgggacaaatatcattgcagttttcaaaatattgatgtcaattaattgtttaaacaagctaaaaacttttaaacaatgcaaaaaatattcatctggataaaagaagggatcaacttgaaattggtcacatagaaattatatataattagttgctttctagaaagtgaattgagaaaataaccagattgtttattttacataaaatcatttagaagtaagtgttaatagtgggcagataatgttttctgtgtaccctgccatattcctcagtgcctggcaaatgtttgtaacatagagggatgttcaataaatgatgttgcatggagtagcacaatgccacctgataatgtattttcatttcattccgaatagctattgttttctgtagctttataatggtctcaatattcttgattatataggccagaatatgtgggctttggaaatattttcaataattagattttgttttctgaatgcaggaattatacagtgattattcctttacttgtgctctcaaagcccttcctatatactgctactataatgatatattatattacattatatgtcatatcgtaactacttctacatgtacttgcctctaacctgaggttgcaagcaactcaagggtgggatttttcttctcgattttgtaccctcagaacactatacttctgctatgtagtagtgactgtttattaactcttgagggattggatgataatctgaattccgtttgtcttttttcagccatacttttttttgaaaagtgtcaattcatgaaaatgatgttaatatttgagagcttatgataaacttattaaacccatctacctagtaaaataatgtattgaacttaataccacaacaaatagatacattttaaagtttagctcaacatactctataaagattaatatattacctctgtgtatattgcaatgttctgtttcttttaaaagacaccagtaactttaaaaatgttttttttatttaagtagcacaaactccttaagagacatgggcacattatccctctcaatcctagaaacgtgaaggagcaggccataccacctcagaatccagagtgatgtgtatgggtctattatacatgtttataaatgttgccgggtccatgaattcttcggatttgcacaagtactttatgatttgttctgggaggagtaggtcaggtgcaacttggtgtaagttatcgcctggtcctttagtgcctactttcatagtctggcaaaggtagagtgacagtttatgagtttgtgtgagaaaatctgtgatgacctcctttagggactgtgactgtgtcacatcgtcgagatacataactggaacttttatcactgaaacatgccattgcataaaaagcctcattggaatgttatgagaaatgactataattttcatttgttgaataaaaaatactgtttcatctttgacatggccaatataatctaaaagaactttgtagagagtgtcgctggaggactcgaggatatgcagaatggaagtgggatagatgagcagcaatcctgtcactgcttctcctaggtgatgtttcaaaactgactgaaacatttgttcatagtagtcagcaacatcttttctttctacatttgcttgtatcttggccactagaaacatcctatcaagaaggaatttctttaggtgtagtcgttgtttctcttcttgaaagtgcaggtaattgctacgtgggacttggagaaaaagaagaggttccagtggcaaaggccttttgctgcccttctggttatggaccgaaaaggacatgaggagtcttatttatttttccagatgattccagcttttagcttatcataatatttatgctgccagggtacctctttactgatgaactcgtgtttttatttcttctgacaaaaaaaaaaagagtaaatcacggtttgtcaaatgttactaaatagtaaaatcccaatcttttgccagttttatcaggaaacaatgtatttgaaatgaaagacaatgttaaaacaatactcaaactatagacttttttaaaagtttacaacgaaagagttaaataatatcctaggaaaaaactttgtaaatgtcatgtaatggtgattacagattgtcctttataagccaaattttttaaaaatggtattttatggtaattcttccagtttcttttacaaatctaactgatctataacttttaaaaaaaaatccaaggctttttaagtcctaattagcttatgtaacctttagtcatgtcactaatagttaataatgttccttgaataataacagtaaacatttcaagggaaaagttttggttctttgttttttctcctatcgacgaatctcagaaatgattcatttctcccccctttatttgttttcttgttgtttttgttgttgtaagggctacatgaaagtattctgctactttaacttactctgcttacaaatctcctcaatttttttttccaggtcaacttaccatttttcttttttttcctgtgcttctgtcacgcacctgtcctcgaggccctacttgtcctccatcaggctcccaactgccagtcctctggtgttctcagctgtcctgtgttctgccttccctcgggcatacgtgagtcagaatgtcagcaccattaaaggaccagagcgccaagtttcttaatacgggtatctcgacaaacacttcaaagtcactgcagaggaagtgtgaatggcttattcctgaatggtttatttttagtcaggtgcatttgtaagtcagacagatggtgagaatctggacatctttttcctttctttttttccgtttgataaataaaaagtatggttgtagaactcctctgttctacttagacactaactaaagacttcaggaacacatatctgaatctatctaatggtgaatatatgatgagaaagttctatagtaagatttggcttacttaacttaatgtgattttaagagatgcacctcttaaaattgtgtcttaagagatgcatctcttaaaattgcatccacatgagttctaaacagtaattttaaaacaagtttaaaaaacgtttattcaatttttaacaatgaaacctaagaataattttttccctgagttctgtattatccaaactaatgatctaattttaatgataatacaatgataaattatccaagtaaatgaaggcagagaggtgacttaataattaattaattgtgtaatacataaaaatggactattcttcctcattgtgattcactttatcactccctgaagcaatacaatctttccgaagatgtaaaccatggtgccaaaccatgtcattgcccagtctagttattatctcactctcattcttcttacagctttgttggaagaaagtgtccatgttgaccagagccttcattatggccttctctcctctcctggtttctatgatactgcactttcttggatttctttctaaatctctgtatgaggccttgcccggcaataccttctcacatccaactctggaaaatacttaggctctgcgctcatgatgtggttggatctctcgctctacttctttgcccagttagctcagcaccatctatatgtctcttttgtgagggcaggtaagtggtccttaaagccactcttgccactagattgcacgtttgaaattggaaattgatcatggggctttccttctgagcttacctgtggactaaaaatatttttcaatctgagtctcaaggtagacacaactagttaattggggttgagaaagaagaaaaaactgagctcccattctagattatttttgcacagaaaattctcaaattattatctccagtcacttattcacaactcttctctccttggatgtaactctgtcttttcaaatttaaaatgaaaacatttaaacaattattttccttattaaacatgtttccctttacaaataccccacttgtgtctaaattaacatgttttttcctctcagttcccaggccaaaatccttggtattatttgttcatgtttcatccaagttatatactccaactctattctttttactaagtctttttactcactttaatatgccttaagggttcttgatttacactacctctttcatagtcctacttctttatttggattataataagggtctctacccacagtatttctagatttctccaccccacaaattcagctaagagtgtgaaaccataagccctttgatacatctactttataaagttaaaaagattctcattttacaaagtcctccctgctttctttccctccatagaatgctgggaggcaaagcctctgccttcaccacatccagagtgacttctggtatttatttccaatttccagtcatggattaaaccagagagaacatggggacaggcaatggtgtgatttgttacctaacacagctactgatcaaagtcagtaggagaatttatgaggtactgctacccaggagccccttttcagtgcacaaactcaaactagtcttttatacacaggtgagattcttcctcttcatgaaactgttccttactgacagcccaatttcttccctaacatggctgagaactatccctcaagataaggctaaccccaggatgtactgttccacctcaactttctgttgacttcatttacatatttttattataattatgttctcaaaatataaagaattgccacagcaaatgagagtgatgtactatcaagttttgaacaagattgttaactcaccttgtcagtttcccactatcttcttggattccctgaatctcagaataaataataaaaactatttcatagttctgcttgttttatcttctggctttgctcattctcctccaggtctagtttttgtgcactgctttttccaaatctcttttttaagagttctatttccatgggtatcagaaccttgatggcttcccccttcttctaaatcatagctccccactctgatcaatacttccaacacaatatctctctgataatcacatgtgtctttctaccttttactcctatcaaaagaagcttagtggtcatcttttctcaccatgtgtgctttttgttttccttttatttcatatatctagattcctccaatataaacctaatagaagaatgatatttcatcatgataaacatataaactctatagaaaatcaactaagctctcctttcttcaaaagagtgataatatcttaacaaagcctaattgttgttatcttgaaaaacatatgaactatcatttctgtaagtcaaaaaaggcaagtagagacaatgttgcatggttcaaactaatacattcagaagcaatagtttttaatctccatggatggtttgacatctttattccattttcccaatgtaattttccattttcaaattatttttttgctattgggttgcttcctaaaaattttagcttcattgtcacatggctatctgaaaggtttaaaggcaacttgttttcttatcattcatcaatcacactctgaactgtcaagagtaagttctgactagatagaaatagaagcaacatgcaattcagacagtttttgattcattgtcttgtgtaattagaattgtacactctctgctcaatggacattcagctttaagtgcccaggtgccacaatccttatgtgccatctattaagggcaagttatttaccttcagatggtgactcaagagaactcttctatctgtctgtctacgtatctggataaagaagcatttgtgttattctacccagagtgatctgtttagaatagctatccaagttcaagttcaaacaactgataagtcacagaaccttaatagaagcttaggatgccaagtcttctttcaattattctacttatctacctttttaattcaacttatctgatgttaatacatagcatatacttgtaactcgtgtcaaagagtacaccttactattactgatatacttatgccctggtttcctttttcagaaccaaatgctcctgaataacaaatttatcatgtcctttttgtttttgtaagccagacagaaaggattaaaacaattaaataccatttattatttaccatgtgccatgcactagatacttttacatacagtaactaagctacttttaacagtaaccctatatgatagatagaatcttttctacagtttatatgggaggaaaccaaaatttagagtagttaagtattttgcacacaattaaaatcttctctcagcagcctccatattctgtctacctgggtaaagaggaggtaaattatctcctatttctatccatgaccatagtgtcattcttccccctgtctatgagatgattcctctggaaccaaaggataccttatggtttggataaagtaaatttaaagaaaaacttctacattatacctaggtttcagcaacatttatctactgttattatctactcatttgtctcagatttattgacgcctttggtgtgccaggtgatatcattaggcactataagaaatgtaagtctggagcttagagtccagatttcaggagcttagagtcaggtacaggtgatgaaatgtacatgaatctgagatgttcttgagacagagcagggaaaaacaataaatatcatgcaaatgatgtttagtgctttagaaacaccaatttagaaagggtaactctggagttttcttagaaacgttagtgaaagagttctcatttgagcgtggccttcagagaaacaggattgaaggacagcctcatgaattggtctcacatacattcctttaaaatgtgaggttgtgcacttactaaacttgatttccatctggaataccaggctttaaactctcacctgtgctcaggtcctagcgaaacaaaacactctaaatcatttcctttcactttatgtcttatatcaaaatgatcagccaaagagaactaatcatctaaataaatggcttacaacttgggtacagcctttcactaagagcacatataataagctattgagtagacaaaaaatatatttgatttagcatagcaaatctgagtgagcttagttatcaaatcactaggtatttgaacatttattgaaaaagacattccccctccaagaaaaaaaaacaaactacattactttctctggcattgactctcttcaccaatagtattacggaacagtgtttggtaattacttatcaaggagagcgcaggctaggaacatttagttaattgattacaacatttcacatagttttcatctatttactatttgtagaaaaatgtgccaggctctatggaaatattcttgtgaatcagatattttatctgcacatgaaaaatttaattctgttagtagatcttaagatccccatgactatgtttagtacagggctggatgggcgtatacaagagtgctaagatataaacaatgaacaatgaaagcacaaaatttggaaacatttaaatttggctggaagaatgagcatttaagctgggaattaaaaaatagatatgatttgtgtgtgtgtgtgtgtgtgtgtgtgtgtgtgtgtgtgtgtgcttaaagcataaacagcagagggcatatgttaaagataggaagtgtggcacaccattaagaaaatggaaacaatctgttctggctaaagcactagtcctcaaaccacagaatctgcaaatttgttaaactgaagattcctggtctctaggccaaaaatgtctaagttagtaggcttaaagtgagacccaagaatttgcatttttgacaagtaatctcccagtctctctacatacctcactttaagaaagaagaggctaactcacagtgattcaaaccctgactgtctattagaataatctagtggagaattttttattttattttattttatttccataggtttttggggaacaggtggtatttggttacatgagtaagttctttagtggtgatttgcaagattctagtgcgcccacccagcaccccaaaagccagttcccagtcttacttaattaggaattccaccaggaatggaaccctggtgtgtagtttgttaaaacctctccaggtgattttaaatgtagcctggagcagaactgctagaaggtgagtggtgggaggagaggggaaaaaaaaaaaaagtaacttggaagcagtttgtggaggacttctatgccacgctcagaagtttgaattttactccgtggataatagagaatcatgagaatttcctgagtgcctgtaattataactgtttaggaagttgccctgaagtgcagaggaattggagatgggaaatactagaggcacccagagcccttttaagaactctgcagttggcaagtgatccctcttatcttctgccagcttaacagtaaattgtttcaactttgctgaaaaccaatttgcaaatgtaaatcataagcttaaaaatctactctttgactaagtaatgcctcttctagatcccatggtaagtaaataaaattatgagtttcacgttgaagctaagtgaagaaaaaattttaaaaaagaaacaaaattactgacaaacatttgaaatataaagacagtttttatagaaaaaaagaactttgaaaaaatgaatatatgtattaatgaacaactactatgatgcccttgaaattaattttgaagaatatttcaagggaggaaaaatagttattcactgaaacgaatagcataatatgaaaaattatagatatttaaaaataaaatttggatctgatatggtttggctgtgtggccccacccaaatctcatttcgaattgtaatctccatgtgttgagggagggatctggtgggaggtgattggatcttggggcagtttccctcatgctgctctggtgatagcgagggaattctcaggaaatctgatggctttaaaaatggcggtatctcctgtgctcgctccctcccgcctcaagtgaagaagctccttgttctgcttcaccttctgccatgactgcaagtttcctgagacctcctcaatcatgcgaaactgtgagtcaattaaacatcttttgtttataaattgcccagtctcaggtagtatctttataacagtgcgaaagtgaactagtaatatctttcttcaggcacaacttttttctgttttgtttttaaatcagtaaaagaaactgggtcctagaagctacagtggtctaagcagcagcaagtttatgcattcatttttgtttttgttaaaatacgttaaaattgtcacactgctggcacacctcatttgcatgaaattctgtaccacacttactaattgtagtaaagtttccccctatctcagggaaaagaaaaaaaactactctggaatgtaattttctctgagatctaaccgaactttgttaagtggattgggacaagattataaatgatatgaaaaataacattttgacatttgtccatcaaatttaagaaaataatttgcctatataatttttcgtaatttttttaaagataatatattctaccctcatgtggttctcagatttaaaccataatgaacaggaaaaaaaaaaagggaaagaatgcaactgagtgctaaggcagaacattgtggcagaagaaattaatgaaggtggagtatatactgaatatcaagtgcagaatttcatagagcaaacaagataaccgtctatatttttcacatatgcaggcaaagtggattttgcaattgccagttacgttaaatgcactaaataaaactcctaacattgatactataaggcacccccttaagttttccagtctgcaactgtgcataattttaaaatgtttttttgaaaaacattttaagtttaaattggattcccaaccttatttttaaaaagtcacagaaacaagaatagagagaaatctagccatgttttaactggtagaatttcggacggatatttgttttgtattttccaattttttcaagtgtgtctatgttattatgttcagaaaaaaaaacgttaaaaaataaggctattgcaatggtttggtgaatgatgatacatgtgttgctttgtttgtaagtctaggatagtctagcctgagagcctgctattgagtagaacttgtagaatgatggatcatgaaccaaattgaacaaagagaagcttcactctgggaaatctgtacctaccaactaggagtcaagataggaaaatataagggtataagatagggaaattactaagaaacagtccaggaattttagtccagacaccttgcatactactgagtaaaaggtgagtctttaaagaatttgcaccagttggatacagtctgaactaaagcagttgctaagactgaaaatgtgcaagccatcaccaaggtagacaagacctgattcactggatatgggaggttaggaatgcaaggatttagagatgacactgaaggtttgaatatcagttactgggaggactaacattttttctttaaataaagatggaagatacaggaggatgcccagatttgggaagaaaaatagtttgtgtagattatcttgaagtggagtggccatggaaatatccaggtatatatgtaactgtgaatctgaagatctgaggaagtctggacttatgatgaaaatttggtagttgtctgcattgagggtagaactgaaaccatgggaaacaatgaagtcatgagatagtgaaaggaaagaagaaggtggaggagcacattatggaacatccagttttagggagtaggcaaataagaggcagtgaaagaggcaacaacaaatcagaaataggcagagaattaagaaaacacaggcttatgaaggtcactgcaggagaaacgtttaaaagttggtggttgaggtaaaattctaaacaaaaataaaaaagcctaaggactggggtgaccatttaatattggcaattacgtttactagggatttaaagaaaaatagatctggtaaaatagttgagcaaagccaggttgcaagcattgagtggatcaaaggagaataagtggtcagagggtcgaccactcctccacatttgtcagtaagaagaatgaaagcactctgatagtaaactatagaggaggaagatagtagattaatagttgtatagtaatcctaggtttttacctattaaaaactagcatgctgggtttctttttgtcttttctatcattgtgtccagccaggaaggtggaatctgaaaatggaatactgtatggtatgcttcgaaaataccttaagattgtcagcttctatacagagatttggagactacatataacactaaactctcagttatgtttcttttatcttcttttaatcagttttttttcagcttctttgcaggacagaacactaaagctttatgacttaactaacacacagtgcacattatgatgaggtgacataaacacaaatttgaatttatttttttatgacttaaaatctttgtgtaatagcaaagttgctttacacatacaaattttattatgattggagtaatatcttcacaatttcattactcaggcccatataacctattatgctaaaatgtgttatcgataagctaatatctattttagtgcttccttttggttcagctttgaacaattgtcacatggaatggagaaaatttgactagtagaagtttagagctggaggggaacttggtacccctgacataacatactccgtttgcaattaagaaaaccatggcaaaaagagatagatattactgatttcaagttgcttacttgtaaagttgccgaaaaatgtgtactcatgaaatactaaaacagggagataatatttcacactagagtattttttaatatattataaaagtttcagtggataaagtggtgttagagctattctgaaagaagttgtaggaatctgaattttatgacacttaatattgagaaccattaaatgttttaagcagtaaagttatatgatgagttacacatttaatggtgactagttttgggaagacagaaattttatagtcaggtatgccctactaaaacattattgtattccaaatatgcaatgagggtctaggctagaatttagaactttaaaatgtatttctttttaaagtaacagcaatattaatccaagtctaaataacatattgtttttattccatgtaactagagtagcagtatagtaaaaacaacataataaaatatttttaaatattagctatgtgctagatgcctaagcagattgcctttaatttatccaacaagcctttattatcctgaaaccttcccagcatctattaaatttaaagccctttgtccattttaactcaaggtacctccacatttctttggaaactgtacctactaacactagcagttgtggacaattgagagacttatgtatcactgttttaatatatgtgaacataaggtacgatcactttttttgtgaagacaattttgtgaaaatataaaagggtgatgaagtagagcacagtgttgatggtgcctgcttcattaaggacagcacattcctgggggtctagagtaagaatgcagtggtatgggaagtataggcacctgtcctccatcatcatcatgaatgcctctctggtccatgtctcacctgtcattatagttctttgtctcaatgacaagtacctcttaactacatatgtgccactgttggcctcatggaaaccatttcaatagtggtacgtgttccaagagttcccaggcaaagctgttctgggctctgtgtgccttgcgtgctgaaatatagataatagctttgtgcttttttttttttttcctaactcaggaagttttaagtgccacattttgtaagatagtggctgatctaactatgaggaccttatttctaacccattgatttagctagtaggaatcattatttctatgtattttctatttaaatttttaaattttaaattggctatatccctcccactgttcagttgtggtatactcagaaaaatctaaacattaatcatacaaggtgaataaaagcataactataaaggcaaagttctcaaaatcatataattagtttcagagtcaaatattaaaattatttggattacccagtccttaaaattgtcaactcttttagctatacaacttgagtatagattgcagttgctgtgattatatttgctcctaattataatttttattaaggatagtttggatttaagagaggccacacttttttggtttggttttctgggaagagtaactttgttttaatcattaacagagttgcaagtgtaagttaactttcgtatctggcatttactctaccttaatataaggtagagaaatagcctggcctagtcattgttatatgggttaaatctctcatctgcttctcaaaataatgcatctatctaccatggacccacatttaatgcctatctcatttgaggggtgtgtgtgtgtgtgtgtgtatgtgtgtgtatgtgtgtgtgttgttagaaaagttcttaaaacttttcagtaataagccattatcatagtagaaagaaagcatacttttaagctttgcctcttgagcaaactgaaggcccattttagatctcaggctcacagggtccagggaggtgatatttaataagtttctagaggttaaggccaatggtgtgacctgtgttcagtgactcattgttgttagaaatttgcctccagtgatctatttgagaaccaggctagttttacattttttataaggtcattctccaagacctatgcctcttaaaaaaaggaaaattcttcacggtcatattattatattggaattcaagtgcaggtctctggcctagtgtatatcttctctgccttcaaaaaactgttttctttgtgacttaaaaaatgaaaaatccatatcttttttgactgaagataactttatacttttaacctatatttcagaaagccaatctttagagaaaatgaaatattttaagggaaaactaaagcatagccatgctctgcaaacttttaaaacattagtttcaggctgtgattgctgttttctatttgactttcaagttagttttaattggcataattttactatttaatagttaagcatttttttaataataagatataaaggtgaacaataaaaagaacaaaaataagtttatgttataaaaaataaaattaaagaggaagaattttgtatgggtagggtgatggcaaagtcaaataaaattcaaccacaccatacagaagagctagattaaatcttgaatgctttgtgttacgtgagtagaaaagaatgatcgctctgaatactttataacctctaagaggagagaatgttgctgcagcaatatctgggaaatacaatcagtgtgtctgaagccagcatctatttatcttaaattaatcatttttttttctgagtaagtggatgataatcctggtgctgggtgccagtgtctttttattcatgccatagataaaactagagcactcctatgttggtgagagctatacaatacaaaaggtctcaagctgtaactcttctgtaagattatagacagctttatagatttgcaacatgattttgggattgagaatcagtaaataattgtatctaaagtaaaatcttgtgcataatcaagtctattttacctttctgccctcaggaaagtataaacaaggtattctaaatataaggcagtaatttttcttcttcattattaaattctctggtcaaagaagttcctacaactgaagtggaaaagccttcactaaattgtaaactgtctggttgctgttagtgtgagccatagggtgaagagcagcatggtgcctctgatgcagtgaacctcaaatgacaccacattgaaggcccagcaatcaggcttacattcaaatatgtactcactttatctcttctgaaaagaaaaccaggccaggcacggtggctcatgcctgtaatcccagaactttaggaggctgaggcgggcggatcacctgaggtcaggagtttgagacccgtctggccaacatggtgaaaacccttctactaaaaattagccaggcatggtggcatgcgcctgtaatcccagctactcaggaggctgaggcaggagaatcacttgaacccaggagacggaggttgcagtgagccgagattgcaccattgcactccagcctgggggacaagagtgagacatcatctcaaaaaaaaaaaaaaaaagtaaaccaggaaagtagtctggatttttttttaagtaggtcttctttcctaggcattgtcagtaagtattatattatcatcttgtctagggtagagggtagagtagcaagaaggaagtgagatctcctcacctctaaattgaacagtgtactgggatttaaccatcttctaactctcgcattatgtctcaagaatatatgtggatatacaaatatttgtcagtagacattagacattgtgattaaaagctgtgaaaaatatgtaaaatacaatgaaattttggtcctcctggaaaagcatctaaaaagaattcagaaaggaatggagcaatgactcaacatatcagatttagttaagtggtactgatagcaggatgaaagttaacctaacttaaaaattaggtaaggctatgtggcttataagagttaagaactcaaccattggtaagttatgaaatcccttttatagactatgcatagggctcaaggtgacccttagtcacactgacaaaatagtcagcaactgggttgaaatcccagatcaatatagatcttcaattggctaagaaggtaacctcaaaactgtttgtagtgatatcatttccttcttagataaaattcttttaactctggaggatttgtaatttatagtagaagtatctaaaataactaaatttggcagcatatttttgtattaagaggaggtgtacacacttggtattttaaggatttctaatgtgaaagaatctgccttactaagtaacaggttagctttttaattccatcttaaaatgcataactgagtgatttagatctataattttaaatagaaatcttaccaagttttatataacattgaaacatttaagattttatgtatgtatacagaatctattattgcttgtcatctatctatctatctatctatctatctatctatctatctatctatctatctacctatctatctacctacctacttacttaccaatctaccaacctacctacctatctaccaacctacctacctatctaccttccttctgagctatttgatttgtcagccaggcaattttaaaggaattgtctttaaaggaaggatttttaaaaattgggccaatgatcaattgaaatcctcttatactattaaaatatgctagactaataatttataaattgattttaaaaacttgagggtaagtcaggttttgaatttgctaatttgacaaatttatattaagctttaaaaccaaagtaaacccatgaatttttttatgcataacagcttctctcaaggacacagaaacactttttattgacagtattgatttgtcttctcccttatgagaatgtgaggagatagaagtcaacacacatagttagttaagagtgagtgcttcctgccccaaatgttcccagtctttcagcacagttgcttctcttagcagtggaaggtggccatcttcaatatcagtaaccatcctgacctttctgagaccaaaggccaagtagcgatggaccaacctgagaaattgctctcatgtattcatgccaagtttccactcctttattgttttatatgacacaggtaatatacatttcttatagaacatttagaaaacaaacatagccaacaagaagatgatattcacttgtatctcgtaacccagataaattaaccactaccaatgttccgtgatgctcctctgtaattgcaattgcgtacagatgtgtttagtttgaaatataatgagttttagttaacaggtatccctgataatgttgcacactctcactcacacagtcatgcttttttttttctgccttgtattataattatggttttctaccttgcttttaccacttagtaacatgttatgaattcctgttattagtaaaataaaaataagaactaaaagtactttaaaatatatttaaagacaatgtaaaagtgtataaaaatcattaaaaagagctgagcccagggcctcatgcctgtaatccagcacttaaggaggccaaggcaagtggattgcctgagcccaggagttcgagaccagcctgggcaatatggcaaaacctcatctctacaaaagtccaaaaaaaaaaaaaaattatcaaggtgtggtgctgcacacctgtagtcccagctactcgagaggctgaggtggaaggatcacctgagtccagggagattaaagtttcagtaagctgtgattgcttcactgcactctagcctgggcagcagggcgagaccctgtctcacatttaaaaaaaaaaaagcataaaaaagtattaaagcgtaaacaataaagcaatagctttatgtttaatggctgcataaattccaatgtacaaatgcactttgttaaataaccttccaatcttcagcattttaaattgcctacttttttgttaaaataagcaacagtctatgaacatctttgaatcttagctaattcattttacaatttaagtaatttcagatgtaaaatatgtggcaaaatgattatgtattttgtaagagtttgacaaatattttcaagttatcctacagaaagatgaaccagtttatgcccaggagttgcttcttagttaaaaccttgataggataaactgagaaacccaccaaaattagaatgcccatctcagaattaaaaaaaaaaaacattaaaaaacagactaaatagatactagttttgttatcagaaacagttgagtttaaggtgtgaggtgctcttatgttaattctctgaccaaacctagcaaagatcctgccattacatcaaagtgttgcactggggttgtcagaaataccaactgtatggctgttggtttgcagccaataaacaagcaaaaaagctcaacatcactgatctttagagaaaattaaaaccacaatgagatacaatttcacaccagtcagaatgacaattattaaaaagtcaaggaacaacagatggtgcggagagatacgaacacttttacactgttggcgggcatgtaaattagttcagctattgtggaaggccaagaaccataaataccatttgacctagcaatcccattactgtgtatatacccaaaggactataaaacattctattataaaggtacatgcacatatatgtttactgcagcactatttacaatatcaaagatatggaatcaacccagatgcccatcagtgatagattggataaagaaaaggtggtacatatacacctggagtactatgcagctataaaaaagaatgaaatcatgtcatttacaggggcataaatggaattggaagccattatcctcagcaaactaacacaggaacagaaaaccaaatgccgtatgctctcattcataagtaggagctgaacaatgagaacatatagacataggaaggggaataacacacactagggcctgtgagacaggggagggagagcatcagaagaaaatagctaatgtatgctgggcttaatacttaggtgatgagttgataggtgcagcaaaccaccatggtacacatttatctctgtaacaaacctgcacaccctgcacatgtaccccagaactttaaaaaaaattgagaactttttgatgatcatataccatgtaatatcttttgtcgataaattctcatatacactggaaatctccgcttcttgttacagtagcctctaccagagtaattaaaatcatgtaggagtggtacaacctttcttaacacagccaatatagatttcatggtataatagttgagtacttaggcaccagccaataatccatccctatgaatccaaggaagattgtccttcatccattccaaagaaattgacctttatccagtccaaaagtcatttaattttgtctttaatatttctggtaatatagtgtccattacccatgtgaaaaattagtgtgcacttaacatccattacgatggctactatcaaaaaaacagaaaataacaactgttgacaagaatgtggaaacattggaatgcttgtacactgttgatgggattgtaaaatggtgcaaccaccatggaaaactgtatggaggttcctcaaagcacaaaaatagatttaccagatgagtcaacaatcccacttctaggtatgtagccaaaagaatcaaaagtagggtctccaagagatatttgcccacccatgtttataccagcactattcacaatagctaagaagtggaagcaacacaactggacactgatgaatgaattgatttaaaaatgtggtgtgtgtatgtatatatatgtacatgtgtatgtacgtatatatacatatacacaatattattcagccttaaaaaggaaggaaatcctgtcacacactacaacacgaatgaacctggaagacatgccaagtgaaataagccagtcacacacacacacaaccaaatactgtttgagtccacatatatgaggtatctaaattagtcaaattcctagaaacagaaagtagaatggtggttactagggaccaaggagaggggaaaatggggagttgtttaatggatataacatttctattttgcaaaaaaaaaaaagttctggagatgtgaatgtacctcacactattgaactgtaaacttaaaaataattaaaatggtaaattttatgttaggtggtttttaccacaattaaaaaatggtgaattacatgtaatgtcaattatattttaattttaaaattaaaaaatagtttcccataaatcttatatagagttttaaaaacatgtttaattctctcacgcctataataccagcactttgggatgcttaggcggttggatcatgaggtcatgagatcgagaccatcctggttaacacggtgaaaccctgtctctactaaaaatacaaaaaattagccaggcgtggtggcgggcgcatgtagtcccagctactccggaggctgaggcaggagaatggcgaacctgggaggcggagcttgcagtgagccgagatcacgccacagcactccagcctgggccaaagagcgagactccatctaaaaaaaaaaaaaaagaaaagaaaaaaatgtttaattctctgtgtgcggtttgctaaatatttttaagtgttattatattttcttatgtagactaaggtttcttactgtagttgtttttacatggcatcaatttcttcatgtttttgatataaactcttttctcgctactaatatatgagatccatattattctgttgaaattcaacataacaaaatgtatcttggataaagtctagacataggaaagaagtttattgtgttaaatactagaaacttaggacaatttttcaagtcatacccgtcctttttgaaatgtaatttggaaatattcttaagatccacataaacttatatattttcttatctacagggtattttatccattaaagatgctacattagttatatagttgttatacacttaactactctaagacccttagcaacagtccatgcataattgcttggagttttaaatgctaaagaaaaatggtgaatttgcactcactaggttttgtagtgaattcttgacatgcatagccaatgcaccatcaggctaaatagtactcatgaagaaacagagataagacacttctggaagtgtgaaaattctgatttgagagaaatgtatgcagaattgatatttatagtacttattttctggctctaatatgttatatattctgctcttggatattggctaattatcatgtcagtaaatgctgtatctggaaaacattttgtcaagtgaataagacttttcatatttctggtaaaagaacagtatatatacttttatacatgtttccaaagatcaaacagctttaaaaaggtgtacatctggctattatttaaccagactgaataatgcatgaaagaatgtagactctttggaataatgtgttattttaattcttacatgactctgttacagagcaagtttatttccattctgaggtttgatgtataatctttctagtcatagaaccatatgaaccaatcactgtctcttacctcccttcaaacacacacacacacacacacacacacacacacacacacacacacagaaagtttaatgataatagcactttttctactcatatactcatagattatgatgagactcagttgaggcaacttagttcattgaaaagaccatggatttcatgtaaagacaatttggggtttaaatttggcctctatattttattataattggaacattaagctatgaatgaaatcttagacaattttctaatttaaaaaatgggaatagatgccaatgcctacctaaagttgttgtgtagagcaaaatttgataatattaagtgtctaatgtaaactctgacatccaataaaagtttcttccttctccttcatttcctacagaaagatttgaattttttacttttgtttccccttacttttctttcatcttgaaaaaacacaaacaaacatgtcaagtttataactgaagacagataagaaaaattttgaatagtaccctgtttataatcctgagcttttagtggaattatttctgaggattaatcttgtcctgcaaatttcttggtttaaaaataatatatatattcttatatatacatatatgtgtgtgtgtgtgtatatattcttacatatatgtatatatgtgttcatacatatatgtattatgtatattctcacatatatgtatgtatggcatagataaattacaataaaagaatattctaaatgttatatataataaaatatataaaatatatatttttatatattctctatatataacattttaaaagttattttattatttaattgtaatctcttatctatgctatccatatgattctgtagaaactcagtataacaaaatataacttggacaaaagctaggcatagaatacaatttattgtgtttaataccagaaacccagtacagtttttcaagtcaagttttttccatattagaataccagttaaaattagtgtgaggctgtgttattattaggatatgtatataactatatgttaggtatgttattagaatatattatatatattattattatgatatataatgtcccttgtatgtaaccaatctcacattgttgctgttccttcccccttgtgggcacctttccccacttggtcatgctctgatatcccatgcaaggtagctcctccttcccaatgtcctccttcaccttctcaggctctgacacctttctgacactttcactgtgtagttccacccactggataacactttctcagcctgcttaggttcccacacaccgcactcggctttcctcttttgcatatgtgtacctccctgctcttttggggctctgtcttcccatgccaagctgccttcctctcccactgcatggtcaccatttttaacctgctcatgctctgtcagcacactctaggacacccattcacatagccctctttacctttgtcaagctccagaatcccattttggtcattctttctcaaaatgtggacactttccacccttcttggtttctgtcaccccgtaccaggcctcttgctgttgaatgctcttgctatcctactccgactctaaatatttcacaccaggcaattcctccctcttttggcaggatatcctccgcacccaacttcaaatttaacacccctcattgagctttcctcttgcatgaatgtcctcatcaccctgctcagactccgttaccccatgccaagctgcactcacatgcagattcccttcctattacactgggttccaaatcccctttgctgtgccttcttcctgtgtggatgcttcattcaccttgcttagacctaaaaccataaaagctgcagaagaaaacctaggcaataccattcaggatataggcatgggcagggacttcgtgtctaaaacaccaaaagcaatggcaacaaaagtcaaaattgacaaatgggatctaattaaactaaagagcttctgcacagcaaaagaaactaccatcagagtgaacaggcaacctacagaatgggagaacatttttgcaatctactcatctgacaaaaggctaatatccagaatctacgatgaactcaaacaaatttacaagaaaaaaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttatgctgttggtgggactgtaaactagttcaaccattgtggaagtcagtgtggtgatttctcagggatctagaactagaaataccatttgacccagcaatgccattactgggtatatacccaaaggattataaatcatgctgctataagacacatgcacaggtatgtttattgtggcactattgacaatagcaaagacttggaaccaacccaaatgtccaaccattatagactggattaagaaaatgtggcacatatacaccatggaatactatgcagccataaaaaatgatgagttcatgtcctttgtagggacatggatgaagctggaaaccatcattctcagcaaactatctcaaggacagaaaaccaagtaccgcatgttctcattcatagtgagaactgaacaatgagaacacatggacacaagaaggggaacatcacacagtggggcctgttgtgggatggggggatgggggagggatagcattgggagatatacttaatgtaaataatgagttaatgggtgcagcacaccaacatggcacatgtatacatatgtaacaaacctgcaccttgtgcacatgtacgctagaacttaaagtataataaaaaaattaaaaaaaaattccaccatcccttaaaaggctgctctctccataggcagttagcgctaccaacctaatggctctatggtggaattgtccatgaagggaaaggaaagaaagggagaggatacagaaaagattattagtgacttgctctctattttaaatatttaattgcatttataaaagtaaatattttattctagaatagcttcaggtttgcagaaggcttgcaaaggttgttcagggagttctggtataccctgcacccagtatacctaagatcttccattggtgtgatatattcatcacaactaataaaccaatattatggtacattttgtatcaacatccataattgactatgatttccagtaacatttttaaagaggagaaaaggatttcatctgtttttttgcatttatcctgtatcttacaatttccccccctgaactgaactgttattccaatagaggaacactgaaattactggtgtgataggaattccctaggatattgtcctcctctttatagatttttgtggggagttgctattgtaacctataatctgcagcccagcattccttttttactggacagataattttgtgagatgaggcctgtaaagtgcttggcattgtgctcaggccactttatttctcaggcactggagcagagtgctaggggactataggtttttcagtgactgtaaaagaaaaagtttgagatgaggaaaagaaattgtccctggaacctatttttaaaacagcaaaatctataataaatgaataaatgttttattaaatgtccatgaagcataacattatatcaacttcatgagctattaaacttattagtcacaaaaatgtcattatacttgaaaaaatatctgtaggttagattttcttcaccaaaaatctcgagttggcataaagtcattgctgataaattagggattatcctaattaaataaataacatatagccaaaaattttggaagcaaaggggataataattatgtccatttttttcttagaaaaatatatattaatgaaagatagtcaattttaatataccgttatgatgcacatgaaagtaataaaaatgtcccacctacaatgtagtgagtgatcagcaaattttacttctctttctttcttctataaacaaatattttgtatcatggggaattataagataataatgtagaaaatgcatgcattggcaaattccaacaggagatttgattatttgagttcattttgaggggattccatagcataggatataggaaaaataaacttagacttgtagtcagaagccctgggtgactttctcctctgccacttagttactcattaatgttagaaggctgtgtgttgcctcagagctttgatatcattatctgtatagtgggaatgctaatcatatctgtgtatcaacactaaagtactgctcatgaaatcactcaatgaactgtcaggtctatcacaatattagatgaaattgctggtcattattcttgttgttgtactactatgtcctttctttagaagtatgtcagaaccagtgaggttgatataattagaacattttaggctcctcatacagctttcaatgtcaattttcagaaaaatacagattatttaaataaacagcagcaggagatagtagcgtgattgactgtattttcttcactgcccattgtgataccctgtgaaagtatatccacattttcttttttttgttttgttttgttttttgagacaaagtctctttccgtcacccaggctggaatgcagtggcgcgatcgtggctcactgtaacctccacctcccaggttcaagcaattctcctgcctcagcctcttgagtagctaggaccactggtgcatgcctccacacctggctattttttttttcttgtatttttagtagagacgaggtttcaccatgttggtgaggctggcctcgaactcctgacttcaagtgatcagcctgcctcagcctcccaaagtgctggaattacaggtgtgagccaccgtgcctggccagtatgtccacattttctatgtctccttgatttattgatggttccaatgaagagggggttacctgaggcattttggggcagacacctcatgatagatcccaccaacttctttctgcctgctctcttggaagatatatacccatcttgaatgtttcctgcttactgacttgtcctagggacacaaaagtgctaagtgtatacacttttatcataagttttaaaaatccacaaataaaattaaaaaactattaaaaaatttccccttcaataattatatgaagaacatgaattgctaggtagaaagtcattataaaaatacatatacatttaacagtttcattgttttccaaaaaatttagcgcaattattctgaaaattaaaagaaattatgattccactgcttgaaatcctggcatttattgaagattcctcaaaagaactgacccatttgtattggcagggtcataaaactgctcagagttttgctcaggaagcatagtttgtcctgtgaagcttcttaagggtaacttttcaacacattataaatattttaaatcaattggttgaacttaatgtcatttaagttgtaatgaaagctctactcaaatgctgtgccctgaaaggacaagataataaataaagatatatatttttgccacttattttttagcaagtcctgctgaaatgggagaatgttttaaattacaaagcaatttaagaattctaaggagggcatatagattcataacttgttgcatcttttgtaggatacagccagcctgtacttcatgatacaaaacattctacaaaaatatgtttgagaagtcaaatgtctaaaaaaatacaatagacttttttatggtatgggtataatatttcacttttgggaagctatcaatgagtaccatttcttaagcatcatccctgctggcagtgcctttgcctcctagggttcaggtgttccagtgagtgggttcagaccttcacaggcagcaggagaggcaattgcctgcccattatctcctgggaaaaagagaagtcaagccatgagcctccctttctcataggaacgttgtctctgtctgatcctttccatggggacttgatctgaattctgggtggcttgcagttgttaagtcacttgaagtagatgcctgtaatgttctggagcatggtgaagggaaaagtgagtgggatatgccaggcttatgtatgtggctgcctgtgggaaactctctagctgtcttctaaagcagcactgcaagttgccttttcttattgctgttctcactgcctgcaattgaatgaggactgaggaggagggaaggatttggaaagaaagagaataagttgggtaagggggtgctggcagtgacggtgacaatgtgtgaactgataggtgtctgagagtcctaggaatctgcatgggacccctcagcattgaagagagaagggaggggagaaaagactgtgaatatgctgcagtgagaattgtcagaaagcagtttgttttttggcttggctggtgctgctacaattaatagcctaaaagtgtcacagctacctcatgagggctgacttttcttcccttgctcaaacctccatgggtatctctaaatcattgtcagtcaattctggaataaaattgtgaatttggcctacagaaggtggtttagggcatgacttaaaatatacaaacatatctattatgtaaatgtcaagaatcaccttttccatgtgagtgtattgaaaaaactgttatacaccataattccctggtcacaatagctcctgaacaagtcaaatctatatcaagtccaagtctagcgagcattgctaagtgctcacattaattccaaagtacagtttgtatttacttaaatcctactttaaataaaagaattaaatgaccagatagatatgatgaatctatatgtgactttactcgatattttcagttgtttttctgtgtgttgccaataattacaaatggtgttcataaaatcccaatatttccaatacggatatactttaaattttaaaatgtatttcttgtatatgcagtaccatggaaaggaggagaatataatattgaatatagtatatttaaacaatatcctttggccacgtgcaaggttattgtaaacttgcagaaattatagaattaaaaccttataaccatctctcacaggtacttctgaaggagaaataccaaagtcaaacattcttttagaaaaatattggcttcttttctttcaaaataccatttctaactaattataaaatcaaaggaaaccactatagttttaaaagtatctgttttggctagttgaggaaagtcagttattattcagctcacgtaacatagttcatcttatatatgtagcatttttattactgttctagtactgattttagttcattgcaatttatgctatttgcgctctatttgaaacacttttttacttcatatagaagcaaaaagtatgaggaatgctggagcaccattggcttttggaaccattctattctgttattgtaatgaaattattaatttaaggtggaaatccaaaatgttctgtatggtatggtgctagtacaaacggtcattgactcctgtacaaattaagctgcaacactgtttagaaagattgtgggactgtaagaccaactaattatacttatccattttctttttatcacagtgattttcttatcagagttcttaaggcaatgcaactatataggaaagatcttttactagtgctagttgaaacttctgaaatagccttggttgtatgaagaatttttttaagtgagaaccaaagccagatttatttttatgggaactaaaaacatggatactcaacctcgattaacctcatgatagtttaaatacaactaatcttggtttcttgtttatcgagtcattttctctacttaaagtttattaatattattgtcattactgtttatagttatcgctaaatacagcccacaggccagttggtgctgaaagggaagaccttttatcctataatgtttaattacttctttcagcttgggaaagtatgggcagaaagatagtgaactttagcataagaacaattgaacaaagttctatttagtctgatggttttcctcaattgtaaaattgattctcttgatcaatagtgtagagagaaaaaaaggtaatgctgcagagaagtgaggtggaaaatggtaccattcaataggacttgacagcagcaccacaatcttgtagtggcatagattccaagaatagctctgttcatggccactagtaaatacaaataaaataagcaaacacaatttaaattattttccactttgatttagtcacatcatttgttttgtccattattttgacagagtcctctaatgaagcatttacttggtacaaagaattgtgtaagggatggcagatatattgttagaattttctatgtaagtctagttataaaaatgcaataaataggccggacacagttgctcatgcctgtaatgtcagcactttgggaggctgaggcgggtgtaccacaaggtaaggagttcaagaccagcctggccaatatggtgaaaccccatctctacaaaaaaatacaaaaattagcctggcgtagtggcagatgcctgtaatcccagctacttgagaggctgaggcaggagaattgcttaaacctgggaggcagaggttgcaatgagccaagatcgcatcactgcacagcctaggcgacagggtgagactgtctaaaaaacaaaacaaaacaaaacaaaaaaccaatacatatataaatatacaaatacattcagtgaagtcatagtgcatatatacagtagtgagtgaaatactcaaaacacaaaatactcagtgatctccatgatgcctcttgcacaggtataaacagcctggacagtaatttttcctgagaatgcaagaatatgaacttagatgtacttgagattcagatgtattatactgacaaaggtgtttgacaaattatctcctgactgatgccacaattcaagatgggataaaggattttctaatagataaaggtcaccaggagaattttaggggtctgacagggggtgccaggctcagaatcagggcatagatggtgggaaggaaggcggcaggtacgagatttcagtggggaatggcagtggtttccagtgcagtgagctgagtacaattgggtaccacccttctcagtccccaggtaccatgagcatgtggcaaattgtaaatcactagttggacaaggacagcttctactattgggatctatggatgtgctcactgatggctggacactagaaaaggaaggtgtttgcttactggcttgagagaacaatgagaagaagaggaagaaaatgtcagtaaaaaagaaaagcactgatggaagcataagacctgaagaggctacagaatgcaggaggtcctatggtggccaccccagaaagaatgagcagcagcctgaatgctcagagagaaaggaaaatgggacagctgcagatggcaactcacagattgcagcctagatgctcgctggcctgctactctatccctgacttcacatgtacaatagcctgtgtcctctggtctccatggtgcagagaggtcaaagtacactggtctggtttagccttctctacaatcccaatttttctgagagcattagaaaagacaaaagaaatgggagtgctaagcatttggtatatgagggtgatatggtttgcctttgtttccccacccatatctcatcttgaattgtaatcccataatcccacatgttgtggaagggacccagagggaagtaattgcatcatgggggcggttagcctcatgctgttcttgtgttcttgtgttgttgatggttacataagaggcatttcccccacttcctccacatttctccttgctgcctccatgtgaagaaggacatgcttcctgttccttccaccatgattgtaagtttcctgagacctccccagccatgcagaactttaagtcaattaaacctctttcttttgtgagttatccagtctcaggtatttcttcatagcactgtgagaacagactgatacgtggggctactaaatcaacatatgtacaaactttaccttatctagcaccttcaaatcaatgttgtttaaacaccacttcttgacctgttcctggccctttcatctatttcttcactatctcccataagcttgatggtgaataaagctcattttgtgttatcattgactttctggctctgtccttgatttcaaacattgcatctgatgcattccagatcgtggaaccctatcccagaattaaagttaagtttgtcttagcctttataagtgtggagtaggcagacaaaataatacgatcaaagacttacaatcagtagtaatgatcaaacaggtctatgaaggaagtttagaataaatagctaatgggttataaaagttctgaatggagaaggcaatcttaatcatgtatagctatatcactgaggggaaatccaaatgatcctggctttgaaaacggccttagaaacttctaagcctaaacaaagtcaatgacatattagagattttctggtacatttatgtcctcatctggttctgtattcaaaggcagcaccatttcaaaaaattggatggaagcgtggattggggagtgcagaaggagctgagtgggatcctgtgagagatgataatagtgcataagtgcatatctcattttccagaatcacattgctcaaaatatcagctactttatcagcaaagctagaggtcctggcagtggtggtggtaactccacagcttatgtgctatggactctctctcaataatctccaaaaatcgactaacaatgagaattttactagaaaaagaaatgactttaatttacagagtccaaagaccataggtcactagtctctgagcatctagtatatggagaaccagacataccaatcagacactctgagaccccagcagcactctcagattgcagcctgcatgctccccagcctgctactctgtccctgacttcacatgtacagtttcccacagatacctgtgtcctctgtctccacagtagagagaggtcaaagtaatataacagaatccagaaggcctggccttcagcatcactgtgtccctggctaatacaaaggccatgtcacttttccttgctggtcctcatttttctcactttttataaaagagattgagtctggatgactcctcacatctttcccagcactttgaatttttaaattcataaatcatttgagaaaattttgctcagttccatctgtacctgtatgatgatgctgctcacttaaactcttcctctgtctcatccaatatccaccaagtgccgtgtgactcagtttcctctttgtatcagtgctggcttgggtgattcctgcctcctctaagatggtgaaatatagaacaaatagttcctattttatttgtacatttcctttttgtgaagtcagttttgactgcaaaaccagcaaatcttctgtgaataactccttttgctttataataaaataggaagatttctgataacacaggtgattcaagattgctgaaaggtttaatgatatatgcacttgaagtgataaacgaattatgttgaaaaagaaaatacttagaagtgaatgatacagaattgtctgaaaaacattgtaatctcagccatcatgaataaattcaataattttactacttctaaaaaatgttctacaactgatgttatgtatttgattagagaaaatattccacaacatttcaaaaccttttaactcacataatatatcctactcataacaaattttagttttgaaaactgcttctaaacaagtcacttaacctccctgcaactacttttcctcatctgtaaactgcagagtttgaaatagctaatctctaaagtgccttccggtttgaaaatgttatgattcagttttgcttctcatttattgtatacagtgagaacaactattttagtggctaggcacaatcgaaaacctaatgataatgacttcagcaggggtctaattggagcttttagatataaattcaatttatgctaaggtctttctcatgggccttagttggatggcggctttacagaatattattggggttgggtgaattccaaagcatctttattttatagcagtatttttacttttcaatagagtcatactaatttataagttcatagtgtagaaagactttggcaatgggaattatttttaaatgaaaaatgatgaatatattttgcataggttacataatttcagagccagaagcgatcctggaaaatttatgcagtattaccaggataagaacaatgctaaaataaggaaatacatgtacctgattcattaatcagaagatttatatggataattttctaacagaaaggaatattttgggattaaataataaaagtgaatatgtttccaagataaaacagttgtccccattattcctaccagatgtcatgtggagaaataagcagcaaaacagaaaataattttgaaaattgtgtagataaatatttttcagattatattttgtgaccattatgtctgcaaaaacctattgctcaaaaatgggcactgtattcaaataaatttgggaaacactattttaaacaaagttaaatcatattttaattatagaacttttagaagccttaatattttagtgtgatatttactgttaatttccaagaggatacagtatacacagttttaaaaataaactcattaactagggaactttaaaaatttttgatacagattaaaatatatataataattataaagaaagagtactataaaattttaaattctgatctatgctatcttggaaaacattcagcttaaaatatttgtagttgcagttacttgtgcaactatatatgtgtctttgtatttacatatatgtgtttttttttttaactaaaagacaacttgggaacatattcagaaaaacttttatgttaatgttcgtttttatgctgctatttgtcttcatggtgttccagtctgggttccggggttatgtctttagtttttgccactcatttgggctctaggtgcacttttaacagtttacttttatctgtactttactatcttacttcactctcataacctcaaactgaatttggctcaacctaatttatttatccattgcccacctcgttttccctccactctgaaaaccacataaaggcgttctctgtgcagcatgccgtatttccattagtagtgctgcaacacaccctgccagaagcgtaggaccattctgaactcctttctttctccactgattactgccaaatagttaataagtcttgttgattttacctgctaatagatagctacctgaaaaagaatgaaactggagccttttctagtatcagatacaaaaatcttctttttttctatctctgctgcatgattgtaattgcctcctaattattcatcacatatacttttccaagctcttttttctttttgtcacaatgcatatttaaaacacaaatgtgatcataccttttcttcccttcatagcctctcatagcttcttcctttgtagaaaatgccaaagtccttactatggcctacaaggtcgtcagtgacatttgcactctaatgctttctgatgccatatcccctttctattttttaaaaattaactttatagaggtgtaattaatatgcaataaatgcaaccattttaagtgcacattttgcaattttgacaaatttataactttatatatttagggtataggacatttctatcacaccagaaatgtcccttgggctccttctcagtcaacttcaaactctaccccaggcctttctggtttctatgattcagtgtatttttttttccttcagtttaagtggaagagtccttgacatgttcatgcaatgcagggtcttccctagtgttgtttcctctgcctgggatcctcctctctgcctctaatgccaaacacatacccaattgcccaccaactcttatccatccattttcaatttaaacatcatttcctgagtcatttggaagagtgcctggccacatataaagcactcaagaaatgttagttattataatgaattataaattggtagcttgaaacctattgggttttcctgcaataaaattatagaaaaatggataacagtttaaaataaaaatactaatttgcatctattgagatgatcatatgatttacaaagtgagacagttttgatgagggtatattgttcattctgacatttgctttgaaaccagaagagctctctgtgtttttctttagtctgttattggtcaatacattttcttagatgccatcaaaggtagaatttagagaaaaaacccattagatcaccttacagataatatcttctgtagttgtagggtgccttaactctgtgttcttaatgcacaaaaaaaggtctatgtttacccagctactgaactgttatgtggaagagaaagagaaagaaaaggaagtaattactttgttggggcttatcccatccattatcctttgtctattattacatatctattgttttgatactttttgctatttttaagacaagatctctctctgtcacccaggctggggtgcactggtgccatcatagctcactgtagccttgaactcctgtgctcaaactcctgggctcctcccacctcaacctcccaagtagctgggactacaggtgtgtgtccctgcacctgaacatttttaatttttttaaatgatctattatgtcattgtgaaggctacattgaccaggccatagttctggattaattctcccaaagccacatagatgtgagcttgctctctaattaaatatcaagaattattttaggaaatcttcttggtgggatatcccttctggtgattaataaatcataaagctcaaagaagacagttgaaggagcagctattaaaccaatgtgatcctattaaagggaaactgagaaaaatcgttttagccagaatttgacattaaactttgtaaataaattaaaaattttaaaataatttttttctaaggaaattgaagaaagtctcatataataaagctggatactcttccacaattaaagataaaaaagagaagaagttggaagtgtgttatgttagtgactgatgtgatttgtatttatgtgctctccaaagaccttgtgtagcctggaaacattcatttgttaaaatgctaaaaagtaaaatatttattgtttcatataaaatcctctatgagatgaaaataaaggaagattatttgctttaatcataaattgtgctataatattttactctgaatatttgtgattgtactgtttgtaatagtatcatcagttatgttgattttagtcctctttatttaccttgaatcaaaatttttcacatctcaaatacatttctaaaccatttatttcagttgtttgaagaaagctagttaagctgctattttatcccttggtttatgattttacaatttcttgtgtttctactgacgttttgccatggtgtggccctggcaggatttgtttagggagtgtgctcaaatgagaataagagggaaagagaaaataatgcaaatgctgctgaaggctttcatacaaaccaaatcatactcaattactaaaaagaattagactggggcttgtgttgccaaaaggcatttaagaactcaaattatgtaattaaaatgtttatgttgatcaaattagccagagtacaaagcagtccataacaaaaatgaagttattcaagttaattcaaaagttattaacatgtacaagttagaaatttagcaaaaaaaagaaatatccacctgctacacatatatagacaaatacaaatcactttaaaactcaccacataaagataatttttcattctatttcttttgaaacccgtgtttttcaacatattgggctcctatattcatgcatttttataaccttctttttatactcaaaatgttaacacacccttacatctttttttaaacttttattttgaaataattttagactcatataaaatttgtaaaaatagtatgttttcagtgtacccagcttcttccaatgataacattttacataaccagaatacagtgatcagaaataggaaactgacattggtgaaacattattggtctacactatagcccttatttagatttcaccagtttttatgtatgccccttttgtgtgggtgcatatgtgtgtgtatttctttgaaattttatcttcaatgtagctttaatttgcatttcttttatggtgaatgagttaaatatcttttcataagtttaattacaatttttatatcttttatgtgaattatttgttcatgtatttgcccacttttgtatctggttttcatattctttttcttaaattttaacaattctttaagcattaggaatatcagctctttatttgtgatatatgttgcaaatattttagtttgtcagttttatttagattaaaaaatttttttgaaaagataacagttgtgttaaaatatagttcatataccatatatttcacacatctaaagcagacatttgaatgttttccagtatattcagagttgtgcaaccatcaccacaattagttttagaatattattgtcacttctttcctggaaacaaacaaaccttacagtcattagcagtcactatttccttcccaaattttccaactttaggtaaagaccaacctactttctattgctaaggatttgcctattcttgaaatttctccttatatcctaagacttaataggtctaacagacatgatattttgaagagctataatgtattctatggtaaaatgttgccatatttatttaagccatcatgattattaaatattttggttgtttccaaatttaaccttataaacgatgcatttgattaagttatgactacttttctgttcatttcctaaagataaattttgagaaatcaaattgtttggtcaaggactgggcacatttttaaagcttttgtcacgttttgacaaaaacaaacaaaaaaaaaattgaaagatgttttcaatttgaactccctttgagaatggataattcttgaacctttaccaaaaactataattagagattatttaaaaaattatcttatttgaaagatgcttctaactctctgattaacaggaattcaaattttttataatcacatttattagatattcttatgacagactgaccttgctctttgaccatttataattgaaatgatagtttcttactgattcctaagagcttatatatgaaatatattcacaagttttgtcaaatatattgccaatttgtctccatgttgccttttaaaattttgtttctgctctttttgttctatagatgtgaaaacatttttataaatatattaatcttttgtgttttaatcttgaaaattacacatattatgtatacacctgaaggaaagcctttttctaattcctttatttttattttatccattagtatatgtggaactttttgacttgtataaatattagggggagctctgtgtttccctaattaaacaattgtggcatatgcattctgtagaagccaatggtgatgcatttccacaggaactattcctgctcaaaaaaaaaaatcagtgaaatttgtctaacgtactcttatgccataaatacaaacaattatcataatcatttgcctgtgcttaaagttatttcagtcagcacattactaataatttgctaacttagaatatcaaacattaatcattatattttgtataccttaaaacacatactgaatgtttttaaagatgcagacaaccagcacaccttcccacccaagctaatttcagtgtaatttaaaattgatttgaatctgtatatggaagatgcgcatggcttgttcttaagttttgtggagaaatcagagaattttagacctgcacaacacagtctccttctgtacctgagataaaagcgggagctattttttgtttgtttgtttttcctttctgctctgggtttataattagaatacaaatagtcttggtcctgcaaaaaaaaaaatctagggaagaattattgatataaaatagatttgatttttttatggcatttcctgaatcagaatcaaattgtttggccgaagatgtgtttggttccatcttaactgttgctgacttcagtcattgctgtttgaaatttcccttaggccgaacctagcctatagctcactgcttgcactatcatcctgtggggaagcaaaacaaaacaatactggcacagaaatcaaccttctcccataataatgtccttaggaacaggcctgatagccacattgaaaaaagcatagttgcaccatatctgatgtagccatttcttgcactatgaactctgaggaatttaggctggaccatcgatttgaaaatacatcagtgtcagtgcagtgaggccagggcagtttgaatggtcgtcttcatgctaaaatctgattgtttttattgaatgcttttattttttaacctgttgtaaatttatatttgcataatataaatttgcaatttaatattttatatcctctttcaatatttcctttctgctttttttttttgctattctatcttccgcttaaaaaaaagtaagtattgttgacattaatcagtttcaaggatgataggaaaaagaggtttgtttttctaactagttatctcccctttctaacttcagaatatttgaggatgcaatctcacctctgttatttactgtgagaatttgaggaaattacttaacttttctgattctatttttctaatccgtaaaatgggatgaaaactgctgtcttgtaaggcagtagtgagggttaacaggttctttagctcttacaaaaaagtcaagtgattacatgtatctgacatgttgctagggagttacaatattaagatgaagaaggtagaaagtcagggacttggccctcaataaattttaggaccagtaaaagataggaaaatttagagtctgcgagtttgaaagagactggttctagaagagcaattcattatttctgctaataatataatgcaaaaaatcagttgccatcatatttgaatgtttgttttattattaacttaatggagagccttaagtctattgacctcatgtgagaaagccaagcttctcaaataatttgattgcatctctgtgaatttatttcactagggtgaggaaattgagaaccagagacttggggtgattttcttaaggctttagtgacaagatcaaggctaggtccaaatttccagtagatttatgtaacttagtgcatttttatacttatgccaaaattacttattttctttttatcagaaacactattcagaaaatgagatcagatgttttttcaggtagagtacaattaaaaaaagaaaaaacaattacagagaaagctcttatccagaaatggggctagttttcagcatctatttggaatttaaatgcattctagtgaactccaagcagattagcctgtatttgaaatataaggtcaagtgggaggttataatcagaaagaattagaactccagaaattaaagttaccttgagagtaaatggctgttctatatggaattattttttgttaaaacaattttacacaaaatgcctttataggtaactattattttaaccaaatgtaataatatacgaatgacatgaaggaatgtaggctatattgcgaattatttttgaattgtgactgttacagctattataaccaggagtgtagctaaaaacctagtattatgtattaagacaataagctgatcacacatattaattcgtgctttagaattccaatatagtctatacaagaaaaactagtcatctccagttgcttaaaagacaagtaattctaataatcttgtgaatgcagaattgaaaacgcacatgataatggataatggagttaaagtaatagaaagttcttgaagaaacttatgaaccccttctgagatttactttataatgatttatagattatcttgattggcgtgatggtattatgggtttttatatttgtcaaaatttattgaactatacgctcactttgtgtatatattttactatatatatatattatatcccaataaagtagtttgaacaaaacatcaccttaagttgaacgatgctatattgatgtcagatgctctgtttgccaaactatttttcgccattcaatctccttgttctttatactttgatactttggttgctagaaatgtagctcttgggaaaaaataaaaataatacattcttaataaaagtatgatgaaatactcacttgcaaaatgtccagaacaacatatgacagaattttgacatctatgaaaggcaccagccctctttggatttctgcagcattttcttttgtacaaggaaataatgctcatatagaaaagacactactgaactttcagaggtctcctacgaacggaactgtagtactcattgtattttaatcaattggagttttattctatttttatattactttaaaattggagtttacacattggtaatattaacattttttagtggtaataaaattacatgctgcaaggaaatcaggatacagtagcatactgctttaatttttagaagttagtgtgaacccaagatcatgaaatcacttttctatctctgttgctgaaagcttctgaagctggcaatagaagtagctacaccttcacatcaccagtactcctgattgcccccttgtgtcgatatattgaattttaatccccgtcaaaaaaggggaaccaggccttcttagagatctcattctgttgttggaggagagatcattcagaatgagcacagaattttctattattgcaaaaagcaaaaagtgtttttaaatatatcaaacctattcctgaatggacaaagaaccccactgaagaaggctatcactggccaatggataaaaatgtaagcttaaataagcttgaattcaaatgaaaataatttgaatctgtaaaaagccatgagttcaaaatataatttaaaggaaaagttacaataaaatttgcaatggtgtagttatgatgccaagaaagggtaacttcgatagtagatatttgctttttatttattttatcaactatgtagaatgtgtgtgtacaggtattctatatatgcatatacatatatcctttttcagtgtttaagattgtttcatgtatatatagttattaattataagcaaaatgaaagcaaatacctaaaagaaaaagaaaatataaatatttgagctcatataagctctgcatatgcagattgtgtgcatgtatatgtgtttgtgcatctttgtgtagctagtctatgggaaagagtaaagaggattaaatttgagtgagccaaacattctctgtaaaggtaaaaacaatttataaatgacaggatgttgtagcagatattttcttactaaacaatcctggtatatgataaccacttagaaagatactgtatcaaagggacagccaaggtatatacaagggatcaaggtgatcctttgatcacctctggcggtcatacacattaattagttaacaccacgttttgagataataggttagccaggttccaaaaagaagaattgttggggcagacttgaaccttcattttctagtagataaattgccttgattctcattctgttgaagttatagataaattccacagaagttttgaatcacaataagtgactaggtaacaacacaagaataatgaggtagcattgatcatttcaaaagtagagatcacatgttttctggaaaagatgtgaaaggcttggacttaaaagtcccatggggcagcaaatcaaatcactctggactacacaaagaatcacttggtagtcaagcaagaacaacaataacatttacattcagatagagttctatttttaaattaagtaaaattattatcattctaggaagttgctaaacgaagtatctacttcaaatacttaccctttagagggcataatactagaaataataaattataaatatataaaaatgtataaatgcacaaatgagtaaatgaatgttgatcaacattctactgaatacttgagggtctctatgcagatttccagagcatgctatctctctctctctctatgcaattcgctctttcccagtattctgtcctgcaaacacttgccacctggattccaagtctcctcacctttggaagtccatcagccttattcagaggagtgaacagggggccgatgtaggaatcacttcatttatttcctgtctgacaaggaactctgttctttgttggctgatgtccagtgttttgaaaaaccttgattaatagtttttggtttttcttttgtttgtttcagggagggcaaaactattttctgttagttcttctttgccacaagccagaaaggacatatatgtttactattattgtaacaaaataggaagtcctcataaagtttttctgctgcatatcaaaataagatggttgcccccaaaaaagcacttgtccaattgattgagttgagagctaaacaatcccctttcttcatggtacacaatatatttttttttgtaaagagtaactgacagacaaattatggttattcatgcttggctatatggcaaacatttactttaaaatgaaagaagtgatcctgtaacttcaagacaaaataagtgatcaatatttgttgccagtgataaaattgaagctgtcaaatgaaatcgaaattttggaaaacttgtgtgacatccactgtgagttgagagcttcccaatacttagatttttctgataaggatgtggtgatattaacaaataaattttttattgtttaataaaacatgttagtattggaagaactgcataactcagtgaaatcatatttttcagtgatcaatggtagaaaattatgcaaatgtgaaagaccatttaaagagtggaatatacaatttaatataacagtataatgtaacagggcataataatatttattaaatggatttcagattgcacattgtaatgaagctttaataagtcaccaattgtcaagttttagtgtagtatcaagggagaacgttcacagttatctggaaattatattaaaatattcctctttttccaactgcgtatctatgtgagactgaattttcttcaagtacttcaaaataacatattgcaacagattgtactcacaagtatatatgagaatttagctgactttcgatggccatctattaaagagatgtgcaaaaatgtaaaataccaccactaatctccccaagttttttaagaaaatatatttactttctactaaaatgtgttatttatttaaaaatataatacatgtattattgttttaaattaaattaataagtattttaatttttcaactttttcttttatgagaaatactgataaatataactgacttaaaaaaatctttgggattttcaattaatttcagggtattaagggattcacagacaaaaacattttaaaattgcttttttaatcactgtaatatcatatacagataaagccagtattattcaagtatgtatcacatgcctggtccaatcaaagctctgttaaaatacgctcaattcttttgtttgtaaggaaagtacaataagataaatactattatagcctccttatagataatggaaaaatgagacataattttcccaaatcataagctaatgtgaaaaaagtcaaaatttaaacacaggcagactgtctctcaagtttgtattcttaaacaccattttatattattctgctaagtgttttgttacatgttacagtggtttcaatattttagagtagaacacatgggatatccttgttgaagtgtttggaaaattatttgaagtatttatttggaaggggcttgaaagtatttttctataattaaaaagtgtttgcttatttttaaagctcaaaatagatttgttacctatactattaagtagattttaacatactaaatatcttttattacacattttttagtttctcctaatttacagagtacattatagtggtaagagcaggggctcagactttcttgatttgacattttagggccatggtcaaaccctgtaaactctttgtgcctttgtttcttaatcttgaaaactgagagaaatagaatctatcttgtaaagaacttttgtgagttccttgaactaataaatataaaagtctcagaaacctgcccttaacatagtaaggcttccaataaatactaactatacttgttataataactagatagtattaggtggtcacgaatgtaacctccataaataaagtcttttaagtagaatgataacttgcaccctttgatgtataatttcagttactaatacatgtaaccagacctcatacaattacggttaactgtattttccatcttcaatgcctgataactacatagttggcgtaatcacaactctcaatttgttagctttataaaaatagttgagccaaaatgttaacgtatgcttagcttatcctcactccttttccagtaggattgaggccagtttatttttacctgctatttagagttatagaaaaacctgggttcctagcatcttatctctgatcaattcttgtgatggagtcccttacatttggcaccttgagaagctgctaagttgtccacatcttaatattaggtaccaggctaagtgctttatatacctttttatatttagtcagatagcaaacccataaattcgttatgttatctgactaaatataacctaccttaggtataacataaggtatacctcctagtttccttaggaggaatactgctgtccagaaagtagagtaatatgctcaatgttgcacagctattaggtggcaaatctgagatttaaggccaggcgaatcatctcatcctttgaaagctaactactttgactttcttagcttcaagaaattgaaataattagattgaaattgaaataattagatccatctataagcttatttgcaatattagatcctgtgattctgcaacagttgagacaggagtatggagaataacacagtctttggaatcatataaagtgaagattgaatccttaaccagccatgttagcagtttaaccgagagcaggttcttcaccgagagcaggttcttcaactcttgtgcacatcatttcttcatctaaaaacaaaaataggcataataatttatacctcacaggatagtcaggaggactaaatcaaataatctatacatagcacgtggcatataataagcattcaacatataatatctcacctcctattaactgggactatttttagtttggctccttgggtgctagcccttttccattagaagagagtttgcaaagaagctgttctccaggtttctgaaagctctggttcttgtgttagccccttcatggaagatgtcaaagaattttagataatactatagaaaagtacaatacaaattgatatccattgagaaggcacattttaggagaaaaatgttcccactgaccagaacaaagttctggcacagaggcagagttctgcagccttccacagacacaggcatgtttctttgtccctgtccatggcaaagctatgctctgacctcatcatccttcaatcagttgttcatctaaagcatttcctttctaatgatcatcatcatgaaggtaatttgcttgattggcagcttattatttcctattaccgggtcctctgctaatgagtatttcccatctggataaatatgttttaaatggaacttcttttggaagagtaacaatatctagccttgtttatgcaacaattgtctgtaaaataagaatgccatgaattttatttacttcagaatagcaatagataatattaaaagtattattttgagtaatctccttaaaattggggatattagtagttgtgttgaaacctgtcaaactcagtaaacaagattctcaaaatacttaactcaacttcatttgtaggacattaaccattaaaccattttctatcagattaacttttccgggatagttttgaactgagatgagattgaattgaatacattaactaataagcactagattggacatacagaaaaccaataattagtattgtagtatttgtgttttgggaggtaggataaagtgttatgaggtgtgatgaacaagctttcttaatgagtgagaaaacagctcaaagtacacattgatctataaacaaaattgactgactataaaataaaatgacttgagattataatgctttcataagtcccaaatttggaagggttatacatccaaatacttaaaatatactcattgactgctagggaatataatatttaatagcagattattatactgtcctagttaaaataatcacatgggtaaaactagagatattctattacactcaactcttatctatcttctttaacttcacacttagataggaaatgattgttaacattccttgtatagcacataatttggcctgtccaaagaaagatatggcctttgccctaggcttttgggaggttatttacatcacacataataggaatgtcattgtttaggatgaatttggatctggatttacactggatcttagggtgatgccagccacaccccatagtcttagagtgggagctattcatgccagaaagaccaacaatgtgacttagggtgaggacttttggtcacattgtatcagttggtctggagactgagtccaaacaatgggcaatcaatctattaagtaagcccacataataaagccacaataaaaactatggacatagaaacttgggtgagctttcttagtggtaatctgtgcatattgttactcatcaatgctgggaaggtaatatgtcttgactccactgggagaagacaatggaaatttttatttggaaccttcctagactctttgtagctcttcctttggctgatttcagtttgtgtcctttctccgtaataaacagtaaccataagtacaaaagctttcagagagttgtgtaaatccttctagaaaattattcaacctgagggtgatttggggacccctccctcctgagcttttggttggtgtcagaagtaaggacagttgagggctgtgctctcaaacctcacagtttggttaactccagggattcataataaacattataagcgtcactaaaacctgtattgacttctgaattttctcagcctaaattatattcagtagaattttgctgttattttggacatactgtatttctcagaaagaggtaatcaaacactcgtgtaatacagaatttatcagttgcctactaggcatgtctagctaacatgtaagattattttattagtccagatatttcactgattgagatatgtcataatctcagctatgctctgctttctgattggactaaacaatatatactttttcattaaatgattcaatacaaatatttaagtaaaatattcatattctggtctaaatccatctcagtttttatatggggcaaatcaaataaaagtttgtatttttttctgtctgattttccctaaggttgtcttaatgacctgtgaatagcaagactaattattttgttatgtcctcatcaattgtacaaataaattgaaccagccaaataagctggttccatttgattagctcccactcactctgcttcagccattgtcatttgttgggaagtgagattacagaaaccagctctcccatgaagtggaacactgccaactctgttgggagaacataaatcatatcacagttatatctcaaatccattattaataaaactttgcactgtgggcttcagcctgcagcagacatttatgaacaggtcagaaaatgaagagtgtaaatggaaacactgtgcctttaattacagctgcacaaatggcagcactagagctacagaattgttaaaaatcagttaaggaaggttgccacctgatctgcctgcacataatctgtttaattaggtagtgtgtttctgaaatcaaatgtttctggaaactaagacttttcaacagcatgcaattttccttagaagaaatagttcagatatttactgggctctgctgcttcaaacgaactaagaatttaagaaataattgcactcctttgcacaaatggtataacctgacccaagcttgttaaagaaactcacctggtaccctcttaaaatgtaatataacttttttaagattcattctcaaatcatttgggcattttataatttttattttagttgttcactaatagaaataatattcatgattctgcaatacagaaaatacatctctaattgaaatatgttcataataatttctataatccttaaattataggaaaaaaattagaatttattttctgctttttaataaataatttgacacatgcaatgaagtttgctgtgattcttcagtagaaggactgttagaaacaaaagctgaggaatgctttgtagtagaaagtatcttttggaaaatactctagtaagggaacatttgaaattgtattattggtgtttgtggtacccctatttacaacagttccatcattcactcagttattgttgaattctagcactatttacttattagctcatttattcctcatgtaattatgaggaatttattaatattctcattttatacatgaagaaattgaaactcaaatgattgtggtaacttaagtaagtagatctatgggcatcaaaataaaacattcattaatttcctgagaattttttttatgatgtcactataaataattcttaaagagtagaataaataattaaattaataacaaaggctgggcgcggtagctcacgcctgtaatcccagcacttggggaggctgagatgggcagatcacaaggtcaggagatcgagcccatcctggctaacacggtcaaaccccgtctctactaaaaatacaaaaaattagctgggcatggtggcaggtgcctgtagtcccagctgttcgggaggctgaggcaggagaatcacttgaacctgggaggtggaggttgcagtgagccaagattgcactactgtactccagcctggctgacagagcgagactctgtctcaaaagaaaaaaaataataaataataaaataacaaatgaagacaatgtcaaacttattgtatcttacttctaaatcacaatggcaattgtaatattttaagctaatttaaaaacattttatgcaaaaagatccctattgatgccgttcatcgatctagaaaaaaataaactcttttaacaatacctggtaaacttctaattgtttataaagattaaaaaattgtttataaagattaaaaaatcttgttttttaatatgaaaatgttaaaacacatggaaaacatatagatcctaacatgactcccataaacccattatgtagagttaacaaatgttaatattttgcaaatttgtttctataacctttttgctaaattattttaacataaattacagatatgatacctcaaacttaaatactttttatcaacttaacatttctcccattataatgccaaagagtatcattactatacccaaaaatgttaactaaatttccttaatattgtctaatatcttttgcatttttcagtttcactaattaaccatgaatgtcttttaaagttaatttgtttaaaccaagatccaattaatgaggcattatttttagttggtatgtttctctggtctctttagcttctgcatcacccccaaccttcttttttgtgacattgactagttgaagagaaagttccacctatttgtctaattccttctttggcctcatagtatcatccaatctgtttctctactccctgtattattgataaacaagaagttagatttagcagcttggttaaattcatattatagtattttggaaatgattcttcataagtgattctgtaaacctactgcatttcatctgatggatacaatgtccaattgtcccattattacttttactaagagtgatctgggaattcaggtggctgcagcatgattccttcatggtagatttgtggttttcccttccccgtctgaatcttgctgtgaaaaatgcaattggaggctgtatatttttaattttctgtttcatgccaatctctgtaataccagtaccatattcttatatttcccctggtttaacacataattttgagatttataataggatatatggggagttaaataatccttaattgttgcagaccattttgtctcttgaataaacatctttaaaatgtgaaactgctcttaatatttgtggatctgcgagctggaagttctctcattaaagcaaaaccatcatagaaatccttttctgtaggtttatttttaaaagaacttagtttcctccttctttccaatcccatgaagatcaggatttgcttctggaaaacttacaaagggagacattgatgctttaataaggcaaggggtggttcaatggaaaagcatgtagcaatagctcttgccttagccagatcagttctgttttaatctattacgtgttgaacttctgattctgtgtaacatttggtttaaaaggtagaaaggtataaacagaataataaaagcacacacatatgcgcatgtgtgcgcacgcgcgcgcgcacgcgcgcgcacacacacacacacacacaataacaacacacagtatacaaaatatgccacctcttgtccacctggatcttagtacatggtgtaggagcctgagaatcacctagatggcattgccactggagaagaatctggaaatcctgaccctagctcctcttcagatgagggacaatgggtaaccatgtatgctttgctagtgtaacccacaggcatggtgcataaaatgtttctgttatttttcaaatggaactggctatttcaagctgctgacttttgctcagggtttttttttttctcttgctactgttcttccttgtttttctgccaagaaaaattttcttttttctttatgagacaggatctcacttcctttgagaaaatcttaattatccttcaaaagcagaatacaagtcacctcatctctaaaatcttccctgagcctctcttctgtcttatcacaagaactttccagtttgcaactgattgctggtataattgttttcctccctaaagtgagaggccctcaaagttgggtggcatgtccttttcatccctgttagtcagttcttaggttataataagcaataaatatttgtttaatggataaaaaatattgtaagccttctgtaaaactggaaaagaggaaaaaaaggaaagaaaaggggagaaagagagaaatcatcaacatagaagtctgagatcttatttaaatctctgactttggaatatcaccagctttcagtgcagaaaggcactggtggtcaaagatatgctgacactggcagaacattttgcattaagttgaaaatttaatttatttacttatgacattaacttaataatgccataactcttgatgtccaataaatctgttattgttttaaattttccaataagcattatttgcaatatgatttactggagcacagtcgaatacattttgcatctgtaaaaccacccgcagagtcactggtaggtactagatatgcttattgaactgagtagaaaaaaactatgtgccaaaaaagaatattcatgaaaaaacaattccagtgagaaaccagataatctgtagctttctggaagtttatagagccactacaaaaaggaggaatgaaaagtgggggataagaaacacctcaggacaaatgttatatgttatctcctcagtgccaccagggatgtgctagtcagagtgtgtaagtagacatttatccacacatcgactttagacgcctcaaggcctggcacagtcagatatgacctggagaaaaataacctgggattggagctcaactgctcacacacaatgcttatttcctaaggcccaggaaggaacaggaagaatggaggcccatttcctttttggtataacattcttttcagagggaagatgaaaaacaaaaaaagggtatatgtctatatgtgagactaccatatatatgtgtgtatatatatgtctatatgtgagactatcatatatatgtatatatgtgtgtatatatgtctacatgtgagactaccatatgtgtgtatatatatgttgttgtatatgtatatattagtgtatatatacacataaatatacacatattttatatgtaattatatacacatacatatatataaatgtgtatacacacacacacacacacacactaacaattacttaaggatatacagtaattattgttccagaaactaagaagaaaatagaaaatggcagcaaagaaatggaaaacaatcctttgatttttggcaaactatttttaatttgacatggtatctggaatacttgaagatactctcagtgtaaattagtttattaaatttagcagaattgactatcttttagaaaatataagaaaaatattaatatatatcaatgaagtgaaaaagcaaagcacagaaaactctttagcaaaattctcttcactctgatagtattcagtctcattctgtgagcataacatttttctcaactatgttaatattccatcaaaaaaaatttgttcaagaaaaactgggtttccaatgacttgttaagaaatcaaaatatttcttccttgaataagaggatccgttttttaaaaaatatatttagctttaggagcttaatttgtaaaccatttctttagctactaatttttaagcttaattttaaaactgaattattaaaatataaaataaaaggaaatttttaataaacttggaataatgtctacacaggtttgatcaggagaatcagtggaatagataatattaaatattttcttcaattaaagttatctaaatgtgggggtacagggatggttggggctcatattatcttcacaatgtttgcattccatgaggtgagatggattttaataaaataaattatgataaagtgtgatgagtgcagcagtggggaaatatgcaaaatctaaatgcacttagcatggagaagagaaaaagaaattctaaggacctggctatgcttccttaagtagtgacacctaaactattgcagttgttcttgttgtggttgtttttcagtagttgctttggttcttagttggtttgttttctaatatggatacaagttctttaagctttcatatataggaataatataaaagggaggaggaaccatgttgaaaaaccatgattcacagacatgaatcagcatatagcatttggggaattattactaatttggtatggctagagcaatggtttccaatcagaagtgattttgcccccacagggaaatttggcaatggctggaaacatttttggctttcacaaagggagtggggaacagtactacagcatccaatagggagagaacagggatgctgctataacatcctacggtacaaacaggacatcctccacagcaaataattacctaggccaaaatgtcaataacatcaaggttgagaaatgctgggttagagcatgaaagcttaggtgataaaaagagatgaagctcaacaggcagagtgtccacattatgggggcagaaggaggagctgggatggctttgaatacctgcttcaggaacaaatgagtagcatgagtattatcagtgatgaagaaattaaaggaaagatgcaggcccaaacacaactgcataggtgtgaatggcacagctaaggagtgcattcacagaggttacagtgcacttagtttttcctggagttgtgcagtgagcaaactgcaccatcagtctcagggaagaaacctttttgcagatgtaaaacctgaagaaactgtgaaatctgaaatgattgtaaagtatatttagattgagatgtttcatatgaaaatgcattttcttttttttttttttttttaaaaaacgtgtctagttttagaaattacggacttgattaggagaaaggattaagaagggcatatagattggtaaaaaaatgggaaaaagtttcggggacaagaaagatcaagaattatgtcataaaaatggtgacacaaatagaggaactagtatgggaggtgctgagccatgaggcaggaaagtttaacattgcttgacaaagagatttggatactagttgttggaagtttagatttcatgcagtaggttagaaaaagtccttgtaagttcctgaacaggagagagatggatgaaaatggcctttgagtaatattgtttttccagccgtgtgttagatagatcatagcatgaagaaaatgaggcatgacagggtgatcagctaggagactagtgaagttctgccctcaatttacaaacaaaatagctgctcactgctccccataaaatattcctttatatacatgaaacgtgctattacgtttcctttcaattttcttgggtatgtacacttagtcctttagccttttctcatcaggcacatttcccaacactgcagtgatttattttgctcttgcctttgtactctccaattttatttttccatatctcacttcatttaccatgattcaaattgaacagagtattctaataaagttcagatcaaaactgagtagaaggaaagggtcttatctatttaaaataaaatatttattttttattttttaaggaattgaagattaagaaaaatgaaaagagtgggcttaatccaacattttatatttttaattataaatattgagtaacaagatatgaataactgattagtaaatgtataagctactgtattaaaaggtatttttttatttttatttttttgagacagagtctcactctgttgcctagactggagtgcagtggcatgattttggctcactgcaacctccacctcctcagttcaagtaattcttctgcctcagactcccaagtaactgagatcacaggtgcccgccaccacacctagctaattaaaagttacttcttaaaatttaaatttaaattttattaatttattatttaaatttaaattttcttaaaatttaagcttgtctttagtgtttatagatggacatttccattcaagcctcatttaaatatatgaaaatttaaaaaaataattgcaaggttattttaaaaaaatatttgccttatttaaaaataaggcaaaattattttaaacttatggagttaagttctccctgtattcaggcctagagaaaaaaatttgacctccttctgcctttcattataaatataataaaaatgtaccagcaaaatacctgagtataaatacatgaaaagacttttttccacaagcccaggacggattaaatgattcaaataataggaagaaattctatatcagataatagactagatttatcttcctatttgaaataagtttttcaagttaaaatatgggaaacaataattctcaagacattttacgttaggcaaagagggcaaagatccctgtgaggtaaaaacaaataaggtgagccttctgccatgtgagtgcttcagtttacttcctggataaagtttccaggcacaacatggggagagggaacccaggtagagcctggctcttttttggagttaaggagataaaactggtcatccagggaatacaaggtggctaaagtttgcagaatagagtatcagaggtgagagacacacagacagaaacctgaaaatctgcatacagtctcccgtgattattcagtagagttctgatcagtgcgtgtatatgtgaaaatcatctgagactcgtggaaaaaacacccaaaaggattagcggaaacatctgggaatagtcctatttccatcaatcagagtgaaaaatcttgtaatttacaggggacagttctcagaaatctttgccccagtggggcaaaatttaccctagacaaaatgcctaagaaacttaatagcaagatccaaaaagaccaaactgtttctaagaaatttaaacatactatagagcaaagatcaataatatttatagaaaaaatatttattacccaataacttaaacatttacaatgaatggcattcaaacaagaagtaccaagcatacaaaaaagcaagacaaacaaacaaaaacaacaaaaatcattcaaaactaatccataaatgacacagattatagaattagtaaaactgtattaaaacatttattataactgtattccatatgtttagaaagccagaggaaaggttgaacatgctaaacaatcatgaaagattttttaaaagattcaaatcaggcttccaaagataaaaagtttcagtgtctgagatgaaaaatacactggttgagattaacagaagattaaacattgcagaagaaaatattagagaacttggaaacagcagtagaaaatatctaatgtgaaacataaagcaaaaagcctggaaaagaaaaatgagtagattgttggtgagttgtgaaacaacttcaggtagcctaatatatgtataaatgaagtgcctgaagaaggagtagggcataaaaatatctcaaggaataatagctgaatattttctcaattttataaaagctatacatctgcagatataataacctcaacaacaaacataagaaacataaaaaagcacaccaaagcacattaccatcaaattgcataaaagaagtgataaaatcttaaaagcagccaaaggaaaaaagacacattttgggagagaggaacaaagacaccactgacagcagatttctttggaaacaatgcaagctaaaagacagtggagcaacatctttaaaatatcgaaacaaagaaaccataatctagaattcttcacctaccaaaaataccatttaaaaacagagatgaaataaagatttttttttccagacaaagactaaatgagtgtaacactagcagacctacattataagaaatgttgaaggaattcttaagtagaaacaaaacattaccacatggaaatatggttctacaggaagaaatgaacagcatggatcagtaactatatgagtaaatataaagagttttttttcttattatttaataccctttatagtcaactgtttaaagcaacagcaataacaatgcatcatggaatttataacatatgcagaattgaaatgtgtgaaaacagtgatgcaaaatttggtaagggagaaatggatacatacttggttcttatatgtgaagtgttatagcattgagtaccatgtgatatgaaatacttcagagatgcaagtgtctgctctgaaaaaggaacatctcttgttttccattgatagtttcttcaagtctaattggcatatagtggtggtgaaaagagggcagggagttttgtcatggtagataccatggaagaaatgaagcccaagatgaaaagataagtttttaaaactttgcctcaaagagggaatgcaaaagttaaaaacacaattcagcatctggttgtacttgcagacagggcaaagttgaagcctgacaccccaagagcatccatcatgatgtattatcagaggaccagtctagtggtatttgatccctagcttccaactagtatgtatttcctagttgtaatgttagatatatttcttactatgagtcatggtcagaatagttggtattcgtttgaggatattttactgatgtgttttaagacagcttcagggattttttttacctagactgattaaggccctagaaggctaaatacctttgtgttgctcagatagcctgatttatgagtacccaacaatcacattgtagttctgctgcccaatccttgttacctggccactcccaataagactcagattaaaaatgactgaccccatgaggaaaaggacccattggctgactctccaagacacacagctgacttatgccctcttcatgatggaatccaagaaaacatctgataacaatggctaacatttaatgagtgtttactctgttccattatgatttaagcagtgtacaagacatcaatcttcatataaacatcaaataatcactttgaggacggtgttaacattttatttttgcaggtgagaaacctgaagcactgaagtaactgcaaattcacacatctagtaaatgatggagttttgattcaatgcaggcagcctgactccaaggttatgcactttatcccaataccaaactgcctcttctctaaactgataaaaactgctctcttttcttgctgaaatagaaaagatatagctttttgaggacccatggctaatcatcaaacaatggttttcctctcctccaacccatttctgtaccagaggagtgaccctaccctgcttggagtgaaaagaagctatacccctgcactcttctctagctcaaactaaggaggaatgaaaggcaacattagataggtatttgcacatgtgtgtttttatccatattctgtgaattggtgtctctgttaaaatatccaatcatctggagaaaagataacctgctttagcttcttctggcattaaaaagtcagtctttcatcagtcagacaaacgtattctgggacaagcttaagtagtggccctcacgcactgttagattttctaacagctgaagggtgaataaggaggaacacaattggaagcagagttaacagagttggcagaagaaatatgtaaaggatttatttagttttgtgttgagggttttgtgatgtcaaggctccataaaatcttaactaaaattggcactgctctcctagagttcttggtaaagttagaatgtattccgggaaatgtagagatgccagtttcaaagaagtggtcattgaaagatagctggattatgctaacattgatttttcacattctattccaagatttttttgtgctcagtagtcaatatctctctaaaatgcttaactttaaatatgtgacattatatcacattaaaatgctatatataactcaaatatagaaagttagtccccaaatattgtataaatgtgtatatatattttcactgaactatcaatgtaccaagtttctccaaattttaaatttaaattttggctaaaaatttcaccaatgtataataaccttcataaagctgagtatgcacagaaccatagatattaagatggtatgaccttcttgaaaatagattatgcttacttaattctaacattcagagctttaagcatgcataaggacttaataaatgtgtgtttattggtgctaatgataagattaaaacgtttcgagggctgttaaaattagatttagcacattgtttaaaaaccacaaattccataaagaaaatatttcaagtacatagttaataatatttttactgcgtttttcaactatttttaattctttaactaaatgtgaaaattaacattttaatatcttggtagtggtttccgtatttcttgggtctatcaacataataataatagctaacctttgtttatttttactataagccaggaaaatgtgttagacacttgaacaagttatcttattaaaaccttaaataactcgatgatgaattcaccattttaccttcattttatatgtacaaaacagaagcttaagtcatcgtttggctaatttcacacacacagaaaataagggggagcaaattcaaaccaccaagttttattccagaggctgtgctcttaagtactgcatttttctttctgtactgcatttctttctttctttctttctttcttcctttctttctttctttctttctttctttctttctttctttctttctttctttctttctttctctttcctttcctttcctttcctttcctttcctttcctttcctttccttcctttccttccttccttccttccttccttccttccttccttccttccttccttccttccttccctttattccttccctttcttcgctttttttttatgctttcagtttttgggtacatgtgcacaacgtgcaggttagttacatgtgtatacatgtgccatgttggtgtgctgcacccattaactcatcatttaacattaggtatatctcctaatactatccctcccccctcccccgaccccacaacaggccccagtgtgtgatgttccccttcctgtgtccatgtgttctcagtgttcaattcccacctatgagtgagaacacgtggtgtttggttttttgtccttgagatagtttgttgagaatgatggtttccagcttcatccatgtccctacaaaggacatgaactcatcattttttatggctgcatagtattccatggtgtatatgtgccacattttcttaatccagtctatcatggttggacatttgggttggttccaagtctttgctattgtgaatagtgccacaataaacatacctgtgcatgtgtcttatagcagcatgatttataatcctttgggtatatacccagtaatggcattgctgggtcaaatggtatttctagttctagatccctgagaaatcaccacactgacttccacaatggttgaactagtttacagtctcaccaacattgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccacttgttgatggggttgtttgtttttttcttgtaaatttgtttgagttcatcgtagattctggatattagccctttgtcagatgagtagattgcaaaaattttctcccattctgtaggttgcctgttcactctgatggtagtttcttttgctgtgcagaagttctttagtttaattagatcgcatttgtcaattttggcttttgttgccattgcttttggtgttttggacatgaagtccttgcccatgcctatgtcctgaatggtattgcctaggttttcttctagggtttgtatggttttaggtctaacatttaagtctttaatccatcttgaattaatttttgtataaggtgcaaggaagggatccagtttcagctttctgcatatggctagccagttttcccagcaccatttattaaatagggaatcctttccccattgcttgtttttgtcaggtttgtcaaagatcagatagttgtagatatgtggcattatttctgagggctctattctgttccattgatctatatctctgttttggtaccagtaccatgctgttttggttactgtagccttgtagtatagtttgaaatcaggtagcatgatgcctccagctttgttcttttggcttaggattgacttggcgatgcgggctcttttttcattccatatgaactttaaagtagttttttccaattctgtgaagaaagtcattggtagcttgatgggggatggcaatgaatctgtaaattaccttgggcagcatggccattttcacgatattgattcttcctacccacgagcatggaatgttcttccatttgtttgtatcctcttttatttccttgagcagtggtttgtagttctccttgaagaggtccttcacatcccttgtaagttgtattcataggtattttattctctttgaagcaactgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatacacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctagtttattgagagtttttagtatgaagggctgttgaattttgtcaaaggccttttctgcatctattgagataatcgtatgttttttgtcgttggttctgtttatatgctggattacgtttattgatttgtgtatgttgaaccagccttgcatcccagggatgaagcccacttgatcatggtggataagctttttgatgtgctgctggattcggttcgccagtattttattgaggatttttgcatccatgttcatcagggattttgaaaccaacgagaacaaagacacaacataccagaatctctgggacacattcaaagcagtgcgtggagggaaatttatggcactaaatgcccacaagagaaagcaggaaagatctaaaattgacaccctaacatcacaattaaaagaactagagaagcaagagcaaacacattcaaaagctagcagaaggcaagaaataactaagatcagagcagaactgacagaaatagagacacaaaaaaaccctccaaaaaatcaatgaatccaggagctggttttttgaaaagctcaacgaaattgatagaccactaggaagactaataaagaagaaaagagagaagaatcaaatagatgcaataaaaaatgataaaggggatatcaccaccgatcccacagaaatacaaactaccatcagagaatactatcaacaactctacacaaaaaaactagaaaatctagaagaaatggataaattcctggacacctacaccctcccaagagtaaaccaggaagacattgaatctgtgaatagaccaataacaggctctgaaattgaggcaataattaatagcttaccaaccaaaaaaagtccaggaccagatggattcacagcctcattctaccagaggtacaaggaggagctggtaccataactgctgaaagtattccaatcaatagaaaaagagggaatcctccttcattttatgaggccagcataatcctgataccaaattctttcttccctttctttctcctttcctttcttttctttttttttttttttttttttttttttttgtcactgctgcccagactggagggcagtggcacacaatctcggctcactgcaacctccacctcccaggatcaagcgatttcatgcgtcagcctcctgaatagttgggattacaggcttgtgccatcatgcccagctaatttttgtagttttagtagagacagggttttgccatgttggctatgctggtctccaactcctgacctcaggtgatctgcccacctcagcctcccaaagtgctgggattacaggtgagagccacggcacctggcctgcatttctttacctataattatctatctctcttgacctctaatgtcactaattcataaatagcaaaaaagtctaaatacttctcctcaaattaggctaacctctgagtttttcttgctgggtattactttcctagtttcctttcttcaaggtactttcaccaacataaagcctcttgtagcaattagttaaatttgataaattttatcacttattggaaggatagaaagtaactttagcaacaaaaatatgaaaataagcatgaatattacttgaagtcaaagggtagttagagatggggtgatgattctttgtttaaaattaaagccattactttttatacagttggtgattatcagagagggacagagagaatggggcatgcaatagaatttgatgaatattttatagttggtgaaaatagaaaagcagttactaaacactgccagatgatgtgctgctgtaggatccctgaagtggtagagcagaatgaacatactggggtactttgaggccaagtacagacatgattaaaaaatctcgttaacagaaaggccataatgaattatatttatagtaatattgagataataataatatcatttgaaagacttttggagacattttagcgtggataaacatagttattttccagaataatgattttgaaaataactgttagcattatgtatttgagaaaacacagcggcaacaactgtgaacttgatgccaatattttctgactttttgtttttctggttctatagctataaggtaggcatattttcaacagtaattttaggaaataaaacagcttgagatggaagattattaatgaggaggcttatgaacattccctgaatgtttaggaatggatatataaatgaacaccattatgaacgcattaaatattaatattgatatttaagtatatattttacttatcattggacctctgtctaatgagcatataggttttattgggtttattttcaggcaacgctcttcaccaatcaaatgaataagaatgaggaatttttgcttactttaggagctatgggtgtgcgtgcatgtgtgtgtttgtgtgtgtgtgctgtttctgtatgggtaatatttaggtgtagtgttttgtctatatttatctaaaaacttatgacttaatgacaactcatcagatacaactaatgagtttagcagaaaaattggattaggccattttttcatctgttttacaaaaactgatataagccagtttaataaaagggcacaagcttttctctaaatggtaattttataagacatttaaaaataataattcaatctacttttatgtgggtcatgatttatgtgagttatgtgaatcatgattcagcaaaattttatttggggaataagaatatactattctctttaattctctctttcattagtttgaataacaacttagcaccataatttacagacataatgttttctagttttgatctgacaacttaaatctaacaattaataagataatttataaataatcaggcccattaggacagaaatgctttccatagcaattatgtgcagctaaatgtttcctcaaggaaacatttgactctatgtccatgtgcatgcatatggaaatatagtgttatttagatataaactaatatctattgtttaagctaatattatataatagatatctgagtattcagaaacaacttaaaaatgtgcttttagtcaaaaggataattcctgaaatttattaccttcatttaaaaaatataaatttccttatgtacttcaaaaagaataaagttatggagctgtgtaaatttctctattgagaaaaatcaatattttataaatatttttaaattatagaaaaagtaaggttaatatttgatgttttatacctaaactttcaaaaatataatgttctcttgcgtctgttttcttttaaaatctggttacactgacttcagatataattaagaactctgctttgttatatttggaaaatcaaaacataccagatttgagctgatagaaaaagaaaatgctcttgctcagagtattacaatataaaatattgtagagggcaatagtatattcaaaacctttttctttgaagaaataaaaaatgggtaaagacttgtgtttgcagtttgtatgtgtatcatttagcagatttaatattttaatttttcagttgtttgcttgacattggagtatattttatccttcctttaaattgttacaggtgacatatttatttttgatacaataagtgaattaaaatgggatttatttgcatatttttatgtatgccctggtgggtagcaaaattatgcttggaaatttctggcttcagtaagttttttagtcttcatattcacaaataaataatctctttaattggatcaaagcaacttacccaaggttcatgtgaattctttatcagcaggattattgtattatgagaatctgagtttcatatttacagtcctgtgtctgagataattggattgttttggtaaagaattgtgctaacaaaaggaaaatgaggcagaggaagaaaagaaggaacttgatacatacaaatagacacgaatacaagaaaaaagttaggcactacattaaccaatgtgagatataaaggaatatgaataattaatttgtttaaagcagtgtacctccagaaaaaattttggtctgtatttggcatcgtcaaatgccatttaataaaatagcaccagaatattgattaagtagtgttgctttgaatggtacagttttatgctttttattccctgggcaaagtaagttattattcctggaagaaataaagttgggcaaagtctattacagaatcacactagtcaattatgctaaatttctgcccaggatgctgactgccttggtttaaactgttagtctttacctcatctacagtttcttttccttcaatagatatatattaatctactagagtgttccagatatatttttaagtgctagagaacataaagatgaatgagacacggtccttgtcgttatgaggatcccagtctactaaatgagaagtattgtaattttttaaatgggcttataacattaatggctaccattttaagcactagtcatgtattaggcattattaaatgttttcaccaactcccttaacatttccatggaattaaagaaaaagatgaagccaggaggcttctgaaactagccagcaacacacaggaaggaaacaaccttgccagcagagctgctgaggaaagaccttaagacatgttctggaaggatccagtggctggaactggaatagtacaaataccagttaatatctaactgataaaataaggcatttaatatagggtgcttaagatttcatactttatcctcagcagaaatgggaaactactacatatttttgtatggattttattgatctctcagcgatatctgtcacattttctactgtggttcctaaaacctttgatacccagtgtctccagtacagtgtcactgtaataacatatcttctatcgtaggtctgcacttactctttacagtttcagtgtacaatttacagtttcagtgtactttcaaaataagtatcttaaagaataagatatcttattcttacaggaatctgagatatgtagcacatactttaactattttggagaagggagaaatgctgagtgttccagcagctatcataataacccttgcatatttttcagtagcataagattagaattatgggaacaagaaggagatgcagccatgtgggatggaggagaagcaagagaagtgaatgctgtgttggggctggggggacccaatgctaaggacaactgacaatcacttcaacatctcccatctgccaacctcactagcaacatcacttctatagtaaactaccatctggcatggctaagaaatgagatgttttactaaataacgtactcagtttaatagaacttttgggttgaattatgtgctttcaaataagtagactaaaggacatgtagtataaaattatgcagcccatattttaaactttctttgaacatctaaaactacttcaggcctactcagtcccttggatcttcataaatttgggggaaaaaaccctcatactttcaaggcaccatgtctgacactgggaatgcaaagatgaaatcctatagcccctacccttaaggagctcgccatttagccaatcgtgcaataattacattgattatagagcatctgagtatttatgtcaaggtacatgaccagcctaggaataatgatggaggtatacaggaagacagaatggaaaattaaacccaagcaacatggaaaacaatgttatgagctgtagctaatactatagatacaacaaaattgaaagtaatagaatgttctagttgaaaatttattccacgggtcctaaagtcacccctttgtagattacttgtaacattacttgtatttttatgaaatacgtgatcactatgtaatttttgcatggtattgactaagacaagagagtaatttcccagtcagaaaatgttattgttgcatactgggctaacccaccctcttgtagtttgtaggtgccaactatgaacccaggttttgttgttttgattcatcgatgtttacgctgtcatttttttttagcttttcctgcttcacactaattatactattcactatcctgcactctgcttttcactttgcttccactcctgtctcacgctgagaaaccatttcacacctgtatcaatgcagtgctctctattcgtcatcccacatctcactgcagttaaagtaaaatttttgaatgataagcctaatcatgtcacttcccctcataatatctattagtggccatgatgataaaagcctataacatgtctacaaggccctgcagtggtctaatccacgcctctccttctagcttcatcttgtactactgtctccgtgctcactatgctacagcaacacttgcctgttttcaaatcctggaatacatcctatggcatcttgtctcatagcttttcacatgctgttctctctccctacaatgctctgatacccctgcccccgaaccctacctcggcttccttaatacttatttatcctgatgtcagtccaaatgacccttcctctacaaacatttttcttgtcctccagaaaaagctggttgtctttgttggtgtgccatgcccattcatagcttgaatatcaatctgtttttgccattttaatataattatattcactcattgaacaggtatttattgaacatttactatgttccagacactggagttacatggtcttatgtccatgtccatgttacatgtaactggagttacaaaagacaaagaagccctattttttttaacgaagtttatagtttaatggttgaaaaaaatgaaatgaataatactttaaaaactgaatttcacacatagtttctgtagatgaaataaaacaaggtgatttggtaaaaagcacaaagcagagagggacaagtgggttatttagagtggatatcaagtaaggctttctaaggaagtgacatttggactgtgattttattgctaagagaatgccaatcacaggagggccaggtggcagaactttcaaggaaagggaaaggccagtgaaaatgtctgtctggaggcagaaacaagcatggcagttggaagaagaagaccagtgtggcagatttaattaaaattggccgtcacgtgcctgtctcctccactagactgcaagtgtctgtagggtggggctctgtctcctttatgtctgaagtttattgtacaaaatcacactttaaaactctgctcagcagttaattcttttgggaagaatttgatgtcttctctcctgctctctgcccatccccaccacagaaacacacacctgcattcatcctgggtagaaatgactgctttctttttgtaattcaatgctactgccttcatatattttttcttaacatgtggaacattttctcgtatttgtttgtttttatacctctcacttctaacaatgtcttgagagtagggactatttctgattcagttacatgtttcaaatgcctagtgtaataagctcttaagcatgcaatcaaattttgttgcaatgaatgagacaacgaatatatactgccttatctctgctatggcttctatttttgtcttggtcaaggtttcttggaaaacagaacctgaggttaggtaccttaaatggtaatgtggttattgagatgtacaatctcagggccaggcaaatggaagtgatgccaggcaggatgagaatgagatgatgttacacaactggctctcaactagttgcttggccatatgagatgtctccagataggctgtttggaaaatccacccctagaggagtattcaccagaggcatgatagagagggaatttatctgctgacttcctcttgcctctagttttctattatttatcaatgtattgatgttaactcccctgggtcaactggccccacgggtaccctatggagaagtaagatctcttgcctgtacttcatctgggaccgaaagcaatgggaagaactggagattcagtgttggtctcaggcagttggtcaacaggggcccacagggtcagttgtggcagtggcagctatggtggaacaaatggccaaggacatgagattgcaggcaaatttgagctgctctgagaaagtgcataagaagtgactaataaaatctgcaaacttgattttcttctaagctctttcttctccacccataaaaatatttaacttggccggacacagtggctcatgcctgtaatcccagcactttgggaggccaaggcaggtggatcacctgaggtcaggagttcaaggccacccagactaacatagagaaaccccgtctctactaaaaatacaaaattagacaggcgtggtgacccatgcctgtaatcccagctacttgggaggctgaggcagaagaatcacttgaacccaggaggcgaaggttgtggtgagtcgagatggcaccattgcactccagcctgagcaacaagagcaagacttcgtatcaaaaaaaaaaaaaaaaaaatagaccagttacggtggcttacacccattatctcagcactttgggaggctgaggcaggaggatcacttgggcctaggagttctagatcagcctgggcaacatagggaaaccttgtctctacagaaagtaaaaaaattagctgggcatggtggtatgcacctgtggtcccagctactcctgaggctgaggtgggagaaatgcttgagcccaagaggtcaaagctgtagtgagctatgattgcaccactgtactccatcctgggtgacagagcaagaccctgtttcttcaaaatattaaataaatacatacataaatgcatatataaaatgaaaacaagaaacaaacttctgtgaccccaaattcccttttaatttcctcttagttccctctctcctttctaccaaaacttttgttccatgtgtctatgcctcacccttgacacaccatggagggccagccccctttagggttttacatctgctgtgctcttatatggctcccatctctttggtcttgctgtcatctgcgcctagagtgatcttttctacttttttatgtctttgtaactcggaccaaatgtcatctatgccacttgctgacccttttcccagcttagtctgaatgtcacgcccctccttacttaaaatggcatcctgcccttccctgaatcataatacttatcacattggtttaatatggtatgttttatacatccttccaaaaatattgtgagaccgaattctctcacttttagattcatctttgtgtattgatttttggttcaatgtcttgtccacagtaagtagtaaatacatgttagctaagcaaaactatactagttaagactaatagaataggcgactgaccagaagatcttatttaattttaacctggaaaaaaaggccagaaaataatacataaaatttcaccttataattaataaactcttgatttaattgtgatttaaaattatattatgaaaatatgttaaagtgatgattatctgtgatagagtcttcaagatggccatgatcaattatttcctttcctttgtgactttgtttcttttccatcaagaggttgtgtttattcccttccccttaatttcagaattcaggctgggtttataacttgtcttggttaacagaatgtgaaagaaatacctgaaaggaggtgaaaagcttccactttctcttttgaggcattcagctgcaatatgagtagtgtatcttcccaatatcaccatgtggtattgtgagaatgactaatctagtcgtgtgaagagaaagaggtcacattaaaaaacaaacaaaacaaaacaaaacaaacaaacaaaaaccctgacttgtgacctgacatgaagctttttgaacttttccgcccaggtctgcagccaagtaaaatgcacccaaatgagtaatcccagccagtgccacctggaacagaacaacctctcagctcagctcatctaacctacagaaccatgaaaaaataatagatcattgttctaatctacaaggtttagggtgatttgttgaatattgatagataatggaaatacccatatttagcttggcatttcctttaaaaatgagtcttaactttatgacttagtaccaaaatggttggcttctgataatgaccctagaattgattacagtcaagcctgatcattcagtttacaagagtccaccaagtgtttctgtgaaagtagaacattatagaatgcattataagatgggcacaacagaattgtgtgcattgctttgtggccatatgcacacagtagactcttattagtggaatgatgagtacataagaaacatgagaaaaataatagctggtggggaagactctaagtaaaggaaaacccttgacatcattaggagtaaacttgctgtattagggttctccagagagacagaccaataggagatatatatatatgagagaggcgatttttttagggaaattggcttacagtattatggagactgagaagtctcatgatagacaataggctgtctgcaagctggagaaccagggaagccagttgccttactgtccaaggctgaaagccttagaaacagggaagcctgtggtgtaactccatttgtggatgaaagccacagagtccaaagaccagagaacctggagttttaatatccaggggcaggagaaaaagggtgtcccagatccaagaaagagtaaacaaatttgccttttctctgcgtctttgttcatctgcatgcttcactaattgaatggtgcacacccacattaaggggggattttcctcactaagtgtacagactcacatgccaatctcctagggaaatactctcaaagacacatctagaaatcatgttgtaccagttttcttggtatcccctaatccagtcaagttgacaccttgcttacttgcaatcatgcaactttctaacaatatgttgaaaataatgttagtaataacaataacaataaaaaagcacattttattgagttcttatatatgtctagaaaatagtatctcatttaatactcagaataaccatatgagacagttgctataattatagctacttcacagttaattaaactgaaatatagagaaattgagtaacttgtaccaagccacatgacaagtggtagagtctggctgaaagcagattgtctgatactagacccctcaattgttaactgctggttatactaatatataatgtctgttagcataatcacctattatatatatgtatataaatgtgcaatattcataattctactgtgtgtgtgtgtgagtgtgtgtgtgtgtgtgtgtgtgtgtgtgtgtgtgtgtattatgcttttctttaagcaacaaatgctgccatgacaagatgttttggaataccaaggtcctctatatttcaatgtcgaaggtagtacatagctttggtaaatgacttccctttactgatagcctgactgtacctactttccccttccttctatcccttatttggatgttgtaactggaattaccttctccagtcctccttgctgctcattgaacagctcatgaaccaactgggctatgtatatccattattaaagaacaagaacctgatgttaggacagaataaaggtatttgagtataatatgtaatctattattttctcattacttctacctcaactgttattccttagttctccaaataggagaaaataatttttacctcttttgaaatcacaagcggggttgtagaagtgattttaaacattcaggcacatactcccatacacacataacaaaccctattccacccatcagcttaatgttcttggcaatttatttaactcacactgtgggcaaccactgccagcttcaattggcttgctgcctttattgatgttttcaggacccaagacctttttattcatgtttcccattaatctcagatgctttacaacatttctaaagacaggaaaacatattgggtcaaatttacagctatctttgaactcagtagttgaatctgctaagtcaaacccaggtttcagccagcaaagtagctttgaaatgctagtttgaaaaagactcaaaaagctttcttaggtgtcagttcctcctgggagaaaagagacaggaatcgcattttaatgattcaagtctaggtatatcacaagtgcagcctgtttattttatttttagtggagtgagaagaatcacctattgaagatgctttcttatatccacatatttattttatttttagtggagtgagaagaatcacctattgaagaatctttcttaaattcacatatttagtctgtttttttaaaaagtttaaacccatcacacactacagaggcaagatatttttataaatcacatgctttcatcttacatgatatcttagtaatacagtaattctttaatataaggcttacaaatattttaaaaaacttttcagcataattcttttgagaatagggctagtattggtcacaactataaaacatggcatttatttttggttccctgtcatctttcttccagtcctttgtattacccaccaggtatacctaccttggggcccatctatcagtgcttcagctctcagcaataacctattacttttaaaataaagggtgttttctctgggcaaaattaagaagttagtcagccctcctttgatctttatgacacttttcaacatttcccacccctgcttactttctcttccttcaggtgttagaaaatctttttaaaatatcccctctcactccatcagataggggaattaacagcaatatttattattttattacctaatcataagctaaaacaaatatcttttaaccaaatatatatcaaaatttgtactttaagttcaatttctgagttttaatggtggcaatgttaggtttcagcctcctttaaatatacttttgagtatgagaatatgtgtgggggtatgtctcaaagataaggaacccctggagttgcatgtttaatccaaaggtagacttgcaagtattactgacttcagaatgaagcagtgtagtggggaagggaaaatctcctaatgccttcccaaggaggacaagcaagtgcaggtccagccaaggcttcttacctaggtttcccttgcatttggaagatgtatcagccagaggtcagctgcagataaattagtaaaaccagcctagcaattttaagaagaaatggcttaaatatagggaaatatacaattataaaatagttggaagtactgaaggacaggctctgggatggcctctgtaattctaccacagaccaggccctccagggatgctgccaactgtcaccattagaaaggtgggtgattgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaggtgggtgattggaaaacagccacttcccggttgtcttagatgaaattccaagatcaggaaactgctgcactatttcattagaactgcatcagctgacattgaattcctagaagccatggcttccctctcaatctcaattcacattcaaataaatgatttttctttaatgacaaatgactgtcagaacctaagtcactttcagaggtgtagctgcaagggagtcttgaaaatgcagatttttagctgtctgggccttatagtacagaaaaaggtgagaaaagatgccaaaaggagtcaatcctgacatattttttaaaaatgcaagtgcttgagtcatttttatgacccctgatcaaaacagttacacattgcaaaaaaaggcattgcctagataaacaaaatattcttgaatcatttgctctaaactaggatattatttctaggcctttactctatttacttggaacactttttctgtctgtattattgatgatggcaattagatatgaatatctaatatgtttgtcataaggaaagatattaattgtgttaataagattcagtaatgatataatttaatgccatttgtttctcatagttaagttctagatttcaaaaaatttttctattaaaagattgataattctcaattctgcaaggaagggagaacaacataaactgattttttattaaacccgagaaccatttaggaataaatgattgatatgttgaattgtctcctgcaaataggtgaagatacctgaaaaataaaacatggtatctttcattcttactgaggtgattaaatgagaacaagtatggctatctgaattatccctgtgaactttaataagctactctatctattagggaatctgaactgaagactatgcaggcatacaaaggctcctaagttcagtacaattaagggggaagaagagggaacacattattattataataaaaaagtaaaagtgcaatttaccccagtaaaaaaaaaggcactacaaaaacctgaaaatagtagaggaaaagtgcttttaaaatttttcaattatcaataacaattgaaagataatataaaattcattaattatatagctgaaaatatatactaataagagaataattacactatactttagtggaactgagcaaaatgtaaatattataaagaaacaaacataaaatatatatttaaacttcagtacacaatatgatgctattgtagcatttttccatttgtcgaaggcaatgataaaagtgaaaactgggctgggtgctgtggctcacacctgtaatcccagcactttggaaggccaaggctggcagatcacctgaggtcaggagttcgagaccagcctgaccaacatggagaaactccatctcaactataaaaaaatacaaaagttagccgggcgtggtggtgcatgcctgtaatcccagctactacggaggctgaggcaggagaattgcttcaacccgggaagtggaggttgtggtaagccaagattgcgccattacactccagcctgggcaacaagggtgaaactctgtctcaaaaaaaaagtgaaaactgaagtgaaagtagtaatatgtaggaaattttatgattttccaaatgtgtataatggattttcatggtgaactgtgttttgtattcaaacacaagaatttttaaaactcagacaaaaatggattaattcttaagtgtctcaggggaacttaactggaaattttgtgtatcttatttattgaaatgctataaaataggcaaacacatttaattgggattcaggcggtttaagcacagttcagtattacacagataaataatggacctgtacaaaattgaactggtgctttaaaatccacgatcatgcctgtaatctgaacaccttgggaggccaaggcaggaaaatggctttaacctagcagtttgaggctgcagtgagctatgattgcgccacttcactccagcctgagtgacagagcaagaacctctccctaaaagaaaaaaataaaatccatgatatttcttttttttctttatgttttattttatttattattattatactttaagttttagggtacgtgtgcacaatgtgcaggttagttacatatgtatacatgtgccatgctggtgcactgcacccattaactcgtcatctagcattaggtatatctcccaatgccatccctcccccctgcccccaccccacaacagtacccagagtgtgatgttccccttcctgtgtccatgtgttctcattgttcaattcccacctatgagtgagaatatgtggcgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtatctcattgtggttttgatttgcatttctctgatggccattgatggtgagcattttttcatgtgttttttggctggataaatgtcttattttgagaagtgtctgttcatgtcctttgcacactttttgatggggttgtttgatttttcttgtaaatttgtttgagttcattgtagattcttgatattagccctttgtcagatgagtaggttgtgaaaatgttctcccattctgtaggttgcctgttcactctgatggtagtttcttttgctgtgcagaagctctttagtttaattagatcccatttgtcaattttggcttttgttgccattccttttggtgttttagacatgaagtccttgcccatgcctatgtcctgaatggtaatgcctaggttttcttctagggtttttatggttttaggttgaatgtttaagtctttaatccatcttgaattgatttttatacaaggtgtaaggaagggatccagtttcagctttctacatatggcgagccagttctcccagcaccatttattaaatatggaatcccttttgcattgcttgtttttctcaggtttgtcaaagatcagatagtcatagatatgcggcattatttctgagggctctgttctgttccattgatctatatctttgttttggtaccagtaccacactgttttggttactgtagccttgtagtatagtttgaagtcaggtagcatgatgcctccagctttgtccttttggcttaggattgacttggcaatgcgggctcttttttggttccatatgaactttaaagtagttttttccagttctgggaagaaagtctttggtagtttgatggggatggcattgaatctgtaaattaccttgggcagtatggccattttcatgatgttgattcttcctacccatgagcatggaatgttcttccatttgtttgtatcctcttttatttccttgagcagtggtttgtagttctccttaaagaggtccttcacatcccttgtaagttggattcctaggtattttattctctttgaagcaattgtgaatgggagttcactcatgatttggctttctgtttgtctgttgttggtgtataagaatgcttttgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgaatattagacacatcaacgagacagaaagtcaacaaggatacccaggaattgaactcagctctgcaccaagcggacctaatagacatctacagaactccccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactgaggattaagaatctcactcaaaaccgctcaactacatggaaactgaacaacctgctcctgaatgactactgggtacataacgaaatgaaggcagaaataaagatgttctttgaaaccaatgagaacaaagacaccacataccagaatctctgggacacattcaaagcagtgtgtagagggaaatttatagcactaaatgcccacaagagaaagcaggaaacatccaaaattgacaccctaatatcacaattaaaagaactagaaaagcaagagcaaacacattcaaaagctagctgaaggcaagaaataactaaaatcagagcagaactgaaggaaatagagacacaaaaaacccttcaaaaaattcatgaatccaggagctggttttttgaaaggatcaacaaaattgataaactgctagcaagactaataaagaaaaaaagagagaagaatcaaatagacgcaataaaaaatcataaaggagatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccatctgaaactattccaatcaatagaaaaagagggaatcctcgctaactcattttatgaggccagcatcgtcctgatactaaagctgggcagagacacaaccaaaaaagagaattttagaccaatatccttgatgaacattgatgcaaaaatcctaaataaaatactggcaaaccaaatccagcagcacatcaaaaagcttatccactgtgagcaagtgggcttcatccctgggatgcaaggctggttcaatatatgcaaatcaataaatgtaatccagcatataaacagaaccaaagacaaatccatgatatttctatcatgcttcttgtactctcttctcggaggaattgctttgcattttggctaatgaaatcatgtcccctctttactttctctcaagtctatctcttttactgctttcccagacagatcagttttagcttaccatagcaacctctgggacttgacccagtctttgcagacctgtcagatcagtgttctctcttgagcaaattccttaagtgactctttcctatcacattagatctaacttgctctttttgaattctctaatagggatatgtttaaattagttgaattaatttttgctgctctttctgaatgcacttctgtgagtctaatgagtctaggcttctttaatttaaataaaactataatgcttattccagcatctatacctttatttacaattatccctttgatcaaaatatctgtctgtcatttattcagttaccaaatcctcaacacttctggagatcctaggccaaacttttcttatctatcaatgagttctctgaccactaggtctattttaatccacccgctccctcacttctttactctcttgttgcatttagaataattctgtcttatattgtttgctgttaagttcatgtgttttaatcaattgtcctgcaaaaagctgtaaactccttgaaaacatgggctgtgctttcatcttcttaattaaaagcaataactagctcataggtcactttccaggagttttcaatattatgctttagctctaataaaatctttataagagaatataaatgacctagaaatgttaataaaatatacaccacttaaaaagtatgttgattaaagtgaaattttagaaatatgaattaaaaataagtaataaagacaaacatcacaatgagctttaccttaaaaacatcatctgaggtagtacaggaaattatacagagaatatttgaaaaaaaaaatatatatatatatatataatatatatatatatatatatatattttttttttttttttttttttttttttgaggcagagtctccctctgtcacccaggctggagtgcagtggcacgatctcagctcactgaaacctccacctcccaggttcaagtgattctcatgcctcagcctcctgagtagctgggattacaggtgtgtgccactagggaaaatagaattttaaaaagcaaaatgactaatcaagtctgtgtagatactgactgataagtagaaagtagaacatttctcactctctctcagcattagaaccctgagatcaacattagccaagtcatgaatttgtaggtatatgtagaattagaaagaagcaatttggaaacaactgttaaataattgattgatttatattaaaagagatgaaatctgtaatacatatctatctgaaggtattataatttgaattccagtccctcttattttaggggttaaatggatattaagggagtgtgaaccagtggttaaaatctctttgggacttagaagtatctgagataaaatcctgtctcttctattaattaaggtgtgattgtggcctagttacttagcttccccacccagtttcagtctttataaaataagcataataatagtgtctacctcatagagtgagtagaagattaaatgtgatacagaatttatagcggggaaaaattcttggcatatgaaagtattaaatacatgtttgctgttattgctattattattttcataaaatatattatcttttacattcactcagaaccagagccaatatttctataaactgtattgttttggaattaaatgaaaagttgtgtgataatatgttactcgtttcaatacataaggaatttatacttcttccttacaaaaatagaggttttgagaatattcctcattatttcagaggtgaaacaacagaatatgacagaaaatactgaaaaatactattgtaaaaaagatgcggttaaatcatcattggccattgcaagtaaaattttgggattaagtatactgttaaattagtcaatatgtacattttaactgaaataaataattagcttagataatacttctaacttaagataactcattattctcatttgaacttaaaattcttccactggtggtaatttgaaatgggctataatcccattggtaccttttttatgacaagggttttggatcctcctgtcagaattcaactcagatttaaaaccagactctggtctcactttctccattagataacaccaaagattgccctatttccctttagaatttattatttatatcacattttaaaaaatttggtaatttgaggccttgtcttgcaacttactacctcatggatatatgtcttaacaactcaattttaattttatagaggatagattactcagtattctcatctgtaaaacagatataataagggtgtctgcctgatgagaatggtataggaatcaagagtaaacataagtaaaatgcttagaagagtgtctggcatatattcaaacctatttgttaaataaaaactagatttcttttgcatttttttaatcacctatactatgctatttttgacaatgaaaacaaaattgtacttgaaataatcatgaagaaattggccatttgggataataatgtacttttatgctgaaggctgcttttaactaatacaaatgcatccaatatagataaattagtaaaatcttaatgagataaataaatcagtttgcctttgtaaaactttaaatgtatctaaatttagtgacttaatttagtgacttttccaattaatttgttgtctacaccatcttctaaatatactacttaaattcctgttcccatgtcttaacttttgcagttatgcccaaataccttatgcttccgctcctctagtcctcattctactcatgcttcagtacatcagcgtcacagaccactctgccaggcaatattaggttcacgatgaaaagggagaagaagaaatgttggcagattcccgcgatactcagaaaacagtataaaaaggaccaagtggtttgaaacaggatttaagatgcaagagattacaaagaagccttccttgtagattgaatgttagcgtcaattactgatataaacatctttggaggagacctcgtttgagcaaagttaatgacttctgttctggatgtgtacaatttaaagggcctataatatgttttacccatgcatcctcaacaaggatgatattgccaccaaagggggtaaaaattggttgctggggagtaaaaaaaatcttactttttatgcacaaagtatagaaaggcatatagtacataaacatttatgctactgcatatttatcaaaatttcatggagggcaattaggaaaatattgtctataacacttatgggaagcacagataatgtgaagaagtatgaagttattcaagaagtatggaatttatgtgagaatatgtgtgggagatcatatgtgtgtatgtatgcacatacacatatacatctaaaggaagtcagtgtacacacaggaattgaagccccatgcatagaagagtttaccagggtcagtaaattccaactcacattaagaacattaggagaggtttaaaaatctttctggaccgcaccctgtggaaattcaatttttaaagcttcccgagttaagtctaaagtgtaggtagagttaaaagccacttgaaggcaggcatggtggctcatgcctgtcatgccagcactttgagaggctgaggcaggcggattgcttgagctcagaagttagagaccagcctgggaaacatggtgaaaccccgtttctccaaaaaatacaaaaattagtcgggtgtagtggcagacacctgtattccgagctatgcaggagactgaggcaggagaattgcttgagcccaggaggtggagattgcagtgagccaagatcgtgccactgcactctagcctctaccctgggctacacagcgagactgtcttaaaaaagaaaaaaaaaaaccacttatctggggagaggagtaattaacgaataaaagttgttctgtgacagtcttatggaattagttcccagagcaactgatatgaaagataatttggaacttcagaaaatatggtgttttgctagcagagtcaagggaaaatttgctataaagaggctgagttgtgcagtttgtaatctgaattgtacagaatctgcagttcataatcagtttcagcttttgctgagaatttgaagaatgccataaaaatatttactggatttaacaaaatggagttcattggttttggcaaagcagatgacaagttgaaaacagattacagtagaaatagtttattctatatagattatctaatttctattttttcccaaaaacaccgtggttataatcttttgtctaacatctgttggattgtcattttcttactgatacataacaatgtcttgtaatttaaacattactgaatttattacatattttaaagtctttataaaaattgctttgttgtcttaattttatttttaatttaatgttcttttggttttgtcatttcaaagtttaaaatattatgcagtagaatttaccaatctgatacagtaaactaagggaagacactgggcaggagcaatttatacacaatgagacaaaccaaggaagaaaattttaattaaatttttcttatgtgtaattgaggatattgattaaaaattgatgactttccattttcaatatggtgattattaattttgcttcttttgtcttcctttcatgtatgaatatttgtactgttctaacatctattaccttaatttaatggctagtgaacattattttaatggaaaattctttaaacgttaaggcatttagtgaggtagataatagaagcaaataaacactatttaagatttatattattatctaaccattgcacaaaaggcatctcataactctaactcatagtaaaatgagtatattgatctctccatttcccaaatagtgttttaaagataaaatgaataatatgtcttcatcattattaaattattgtggagatatttaaaattatgatagaaggtttaggattcttaatggactataggttatttataaaaataaatgaatggattgcatttagaaagaatatttataaagctaattttcatacaactttattttgccatccaaataatattttttggacaattgaaacctagatctctgaaaaagaatttcagtctgtactcataaaaatactatgagattatattgctgagttagcaccatgagaacagtgtttctgcaaattttttcttctaggtgcccaccccacagcagattcttcaccaatatttgttagaatttaaatttagcccaattctttaaataagaatgcagagatttcatggtctaagaatagaacaatcagcactctttgtgttctattttactgcttcataaataaagttcttcagtccaagacatctgaacatgtatcagaatattcactaattattgtgaacatattttaaaatggcttaggctacagattctttccttacaaatccatcccattgtttggggaatccaattgtagggtgcttcatatcaggacaaaaaaaataaattagtaaacttgtttctttttctaaaaacgtcataatagatttgcaattttccattatatatttattcagcttatttttggaagatgttggtcttgttaagatatcactgagaatactacattactatgtacaacttatattctgggaactgtaagtaacatttagctgcttaccccaaatggccaagtaaatgaacaactgttatgtcttatcttagaaataaaggttcacataatcatctttcagtgcagagtattaacatttgtttgagaagagctcttcagtagaaaatatagctaatatagacactattattctcaataaaaccaaaacaaagctgtaactctgagtctgttctctttcaccccattgcctctgtaggagaaaacataacgaaagctccagtgctcagcaccagctcatgagcacatttgcctcacttagtgtttaagattgtatgcagaagggcttcatttttagaattaacaatggtgcaattcttcattaaaacatgtatgcctaaagaacatgagcagacacttttcaaaagaagacatacaaatggccaataatatattaaaaaatgctcaacgtcagtaatcatcagagaaatgcaaattaaaaccacaatgaaataccatttcacaccagttagaattgctattattaaaaagtaaaaacttacagttattggtgaggctgcagagaaaaggggacgcttatacactgatggtgggaatgtaaattagtttagccactgtggaaagcagtttggagatttctcaaagaacttaaaacagagcttccatttgacccagcaatctcattagtgggtgtatacccaaaagaaaataaattgttctacgaagaaacaacatgcacttgtatgttggttgcagtactattcacaataacaaagacaagaaatcaacccaggtgcccatcagtggttgactggataaagaaaatgtggcaaatatgcgccatggaaaagaatgagatcatgtcatttgtggcaacacgagtgcagctagaccataagtctaagtgaattaatgcaggaatggaaaaacaaatactgaattttcttgcttacaagtgggagctaaacatttagcattacacacggacataaaagtgggaacagtagatactggggggactattacagcggggaaggaggaaggggacaagggttgaaaaattacctattgagtactatgcacctgggtcacaggatcactcatatctcaaacctcagtgtcatgtaatacccccatgtaacaaatctgcacatgtaccccctgaatctaaaatgaaaattgaaattaaaaaatgtcttccaaataattttttaaatgactatgctttctacaaaaatagaagaaaaaaattttaaaaaaattccctctgggttaaacatggtagagaattgtcacacaaaagaagcatttgccagccatcatttgcaaatttcaagatgtctaggaatctcataaggaaattgtttaaaatgattatttacagcctccactgccagagattttgatctcatcaggttgggatccagggaactccagagactgcatgcatcacattttgacaaacagtgaaaaagaatcctttttttctttgtcttccacgtgtttaaaattaggcagagagttggtgtttcctctttgtgcatacaactagactagatttaccagacattgttacataaggcatggccatataactgagctgtagacaatggaaagtgagtggaaggcaattattggtcctgactcataaaaccttactcaacacacttgtccaagctcttttcccctttcagcctagcttaagtggaggtgaccactatggtggcattgaaagtcaacaaaatgtataggagcaaacatcttctaagttagcagttctcctcaacttcagcacagacacaaatcaaatcatatgcttgttaaacccacagattataaaattctaccaccaaagattttgatttgataggtctagaagaaatgcacaggaatccgtattttaaaaatcatgaggcaattccgatttgtgtgattctggttctataagttgagaagcactgaatgtgtgtatgtgtgtatgtgtgtgtttaagtaatagtgtagttaatgctagtgttggttactaattatatgtcacttatcaaactacatctatttctgcatctttttatatatttattttagaagacaataacattataggttacagaaaaaactggatctccagaaatcacattatagattacagaaaaagaaaattggatctcaagaaatcatctagtttaatggagatcctaatgaaggcagatgtctaatctcactttttctcaaactaaataataccagctacttcaactcttcccttagggtattattttatatgtctataatgattttatcttttttttttctgagcactctccatattctttacctccttaaaaaataaggagagcaaagtaaatatattgataaatgttattaatgcagagtattacacaaaaataatttataggctttacataagtagccattatttatattatatgtattttaaatacagaggatattatttaatttccttaatgtattggagactttaaaatgaaaagtacatgtatcttgttcatttttatatgtctgacttacattggttatcttttgcttctcatatatttattttgctttatatctatatatctatttatcatctgtatctatctatcttctatctatctaattttggcgttttatcttaaagtttaaaaaaatctatggcactatatacacctatatgaccttgattctcctccagtggtttcctatttgtatgttgaggagctattatattttagacaagaagcttggcattttatataaatttcatatttcaaatagcaatttatattgcctattatatgacagatggagaaatgagattgatatgtaataacttacttgcccaatatcatttacctagtaaattgcattgtaatttaacatgttttcatgctcttttgtcttaaaaaaattaaagcttatgagaaaaatttttataatgaacatccttatatagataatttttatttcattatgaaatgaattttaaccagaattatgttgtctttgagtggaagtcaccataatggcagtctacaattatgtttattagtctcgtccattgaatcaaggtgcacatatttcccttctagaaggctactaataataattttctctcaatgcttttccactttgagcttaaggtgctcccgaataaattactacactaaatcctgccatcaaccaatgcaaaagaggaagcatttcaatgcatatataatttgtatccctacttgaaatgcagcattagatttctagtcacctcatattggattattcttatttttgggtaaaattcagtttatgtactaaagattccatcaccaaagtgaaaatagttgggcattatattacattatctgctaccttcctcagagcaggaatttttattttgcataaaaatgtcctttgtttttccctgagtattgaaatgttcatggtttagagtccaaatctctaaatgagatcactagcttgtatttactatgctaatttatcttttctcatagaacaataccgggttttctctgtgactgctgcttttcagtgacgtattgatctgattttggctaaacaatacaatattgctaaaatctggctaagaagaggaccatatcagataattcagtagaactgtatatcattttctattagagaatttatgttttccccttgaatagtctatttttcctaagtttggaccatattaaatatgcagatgtacaaagaacaactataagcaattacaacatactagatatgaaaaatgttttgataaaaagtctattaggaattatatctcctttctgcatctttcagaaattagttttttacttttcataagttttacttttcatagttttcttaagattacttaaagagaatatcttcttgtcattgtgaaatcgataaaatataaaagccatcttatatgcgtctgtttaaacctgctgaaacattataatgaaattgaaaatcaccatacattgtgtgcaataaaataatgcattattagttatattagcactcagatcattaagaaaataaaatgttctttatcaaattttcaagtcaaccttttgctctgaaatttatcactgcagaaaatatttaaatgggaagtctgaatttaatgcttttgtatctatctgttcttttcaggaatttgaggcattttgttagttttccattaaccacaaatatatatcttacatttcaccataagatatgaacataatttaggagacgaattagttcaaaacaatggaccatatttataggatcattaatgcaaataaaggagcagttgtacatttattccaaaattttatctgaaatttgggaggttttgtggtgatggtagatggattagggatgatactcttcctatacagatttcttgctctgcatggatgtatatttgtaggtgtgggtaggtgttgatgtctacttgacagtggagggtgggaggagaggagcagaaaagataactattgtgtattgggcttaatacctgggtgatgaagtaatctttacaacaaacccctgtgacatgagtttacctatgtaacgaaccttcacctgttgtttaaaaacatatttttgcattaaattcagacttcccatttaaatattttctgcagtgataaatttcagagcaaaaggttgacttgaaatttgataaagaacattttattttcttaatgatctgagtgctaatataactaataatgcattattttattgcacacaatgtatggtgattttcaatttcattataatgtttcagcaggtttaaacagacgcatataagatggcttttatattttatcgatttcacaatgacaagaagatattctctttaagtaatcttaagaaaactatgaaaagtaaaacttatgaaaagtaaaaaactaatttctgaaagatgcagaaaggagatataattcctaatagactttttatcaaaacatttttcatatctagtatattgtaattgcttatagttgttctttgtacatctgcatatttaatatggtccaaacttaggaaaaatagactattcaaggggaaaaacataaattctctaatagaaaatgatatacagttctactgaattatctgatatggtcctcttcttagccagattttagctcaatatcactgatcattaaggaaatgcaaatcaaaaccacaatgatactgtctcacacctgtcagaatggctactataaaaagtcaaaaaatagcagatgctgacaagattgcggagacaagggaactcttccctgtaataggcagcaccatcattaaatcatttctttagaaaacaaaaatgcatttttttcatgtttgtgatgtttgttggccatttgtatgtcttcttttgagaagtgtctgtttaagtcctctgcccactttttaatggggttgtttttctcttgtaaatttgtttaagttccatatagatgctggatattagacctttgtcggatgcatactttgcaaatattttctccaagtctgtaggttgtctgtttttatagtttggggttttacatttaagtctttaatccatcttgagttcatttttgtatatggtgtaatgaagggatccagctttaatcttctgcatatggctagccagttaccccagcaccatttattgaacagggagtcttttccctattccttgttcttgctagctttgtcaaagatcagctggtcataggtgtgcagccttatttctgagctctctattctgttccactgtaaaccactttttaaaaaataatgagccctttccatatattctaattgtgaatcttgatcataattatattatgcccagcttatgttttacaaagtgttaaaataagctctgcatgagttcattgtaaaaaaaaaaaaagtgcagatttgtatttaccccatgcatatctttgtacactttctgctcattactacgatcctacccagtctccacaaacacacacagatgtggctttgatattaagttttacatttgcttatatatgtatattctttaaaaaacacaggaatgtatatatatatctgagaattgctatttcaaaaatatatgtattactgaaaatttcagtgctagtaatacatattgtcacttttttactggctctatagttgcagttatataaatctattatattttactttaatatgttcctatagatggacatcattatgcccaaatgataattttaaaaatttagttttatgggctgggcatggtggctcacgcctgtaatcccagcgctttgggtggctgaagtgggcagatcacgaggtcaggacttcgagaccagtctggccaacatggcgaaaccccatctctatgaaaagtataaaaaattagccaggcgtggtggggggtgcctgtaatcctggctacttgggaggttgaggcaagagaatcacttgaacctgggatgcagaggttgcagtgagccgagaccatggcaccgcactccagcctgggcgacagagggagagtctgcctcaaaaatatatatatattagttttatgatcatctattaatacaattagttatcatcaccaatgatttacgtatttatgatacttttacagttggtcttctatgtttacagacaccgtatccataatttagctctgaaagatgattaatgccagaaactgtagagcaattaacacacctgaaacattttatcacaagtagaaaaaaaagactgattgcctatcagacaatattgaaaaattgatatttttattactataactgtttgaatgttttacaatgaaaaaatttcattattttgatcatgctactctgttttacttaagcattttagtattttaaagaggtaggattgtaatccctgaccctgttttttgtttttcgttttgttttgttttgtttttttaacttcaacttttgttttaaagtcacaagacacttaccggtttgttacatagatatattgcgtaaagctgaggtttgggttacaattgattgcatcacccaggtagtgagcataatgcctaatagttgttcagcccttgccctcttcctctctcctgcctcaagtagtccccagtgtctgttgttcccatctttatgctcctgtgtgctcattgtttaactcccacttattagtgagaatgtgtagtatttggtttcctgttcctgaattttgcttagggtaatagtctccagttgaatccatgttgctgcaaaggatatggtttcattcttttttatgactacatagtattcttccatggtgtatatataccatattttctttatccagtccaccactgatgggcaccgaggttgattccatgtttttgttattgtgaattgtgctgtaatgaacataggagtacatgtgtctttctggtagaatggcttattttgggggaggggtatatatccagtaatgagattgctgggtccaaggaactctattttgagttacttgagagatctccataacgatggctaaattaatttacattcccaccaacagtagataagcattcccttttctttgcagccttatcaacgtctgttattttttgactttttaataattgccattctgactagcatgagttagtgtttcattgtggttttaatttacatttctctgatgattagtgatgatgagcatttttttcatgtttgtgatgtttgttggccatttgtatgtcttcttttgagaagtgtcttttcatgccctttgcccactttttgatgggttcttgttttgtttaagttccttgtagattctggatattagacatatgccacttgcatagttggggaatatttactgccattctgtaagttacctgtttactcagttgatagtttcttttgctgtgcagaagtttttgaatttaattaagtctcacttgtcgatttttatttttgttgcaattccatttgaagacagtcataaattctttcccagggccaatgttcagaaaagtgtttcctagcttttcttctaggatttttataatttgaggtctgacatttacatctttcatccttcttcagttaatttttgtatattgtgagagataggggtctagtttcattcttctacatgtggctagccaggtaacccagcatcacttattgaacaaggagtcctttaacaaaattggaaaataaaattatattgacaataagttatttcataatacatttttgaattaggagtaattttagaaatttacgtgaagacagtagatatctataatttttatagaacacatcataataacaccttcacataagtccaaaggtactcttcagaaataatgactatatttctctgaactatttttagtattagctcttcaattttaactttgaattttaaaattatttgtatgtatgatattaagtaaagtgttcaaacaattttttaatgaataaatctcctgtaagtatttgtttgcaggtttttacatagacaggagtttgcatatcaattgagtacatgcctaggagcatgagagctggtattgcatggtaagaccatgttcagctttgtaaattgccaaaatgtcttccaaagtggctgtaccatttgccttctcactatccatgaatgagagttcttgttgctccacatttttaccagtaattgatattgtcaggttggattttagtcattctaataggagtttggtagatttctgtgcagttttaccacataggatgtttaagcattttattgtttagttgctttttttcccaaaattttattaatggaaccacgttttatggtgacattttgcttaaaaatgttttgctgagttattggtggatacatataactgcatgttcttaattttcagttctgtatattatcccactgtataaaatgtaacacaatttattcattttattataaataacatttgagttgattccaatttttcacttattcataacacatttatagtatttatcatacaaatcatgcatatgttagatttattcctagataacagtgatcttctgtggtcactgtaaatagtgccttgtttaacttttttcagttctcatcaactgacatacgtatttatctgttttgttttgttttgttttgttttatcctcctcaatagaatataggctttttgaaaacagcgttaattgtttgtgttgtttactgatatacccctaccacacacaacagtgcatgacatgtaagagaccctcaataaatatttaagttaatgaatgatatagaaacataattgagttttccatgttatccttatatattatgaccttgataatgatcgttaattctatccttatgcactgattgtagatacatctatttttgctttaagtgtgttgagactatatttgtagggtatacacttttggtattgctctctctttctagtgaatggaaattttaatcactatgtatttatttctaacaaatattttaattaaagtctattttgtccaataataatagctatatccatttttattttgtttgccttttatataattttctaccctattattcaaaccttacatgtccttatgcattatatgtctattagactatcatgtaattcactgtaatccaatctgataatctctttaacttgaagtatttattgcctttacctcgtttgaattataaatttgagaacaattctattattttattttttacattatatttgtcctgacttttctaagtagattttttttttttaacttttagcctttctttggctagttgaggctttaattcccctttttattttatttctttctctctactagtctttgttttgttttgttttgttttttgaattttgatgtttcttttttttatactttaatttctagggtacatgtgcacaacgtgcaggtttgttacatatgtatacatgtgccatgttggtgtgcttcacccattaactcatcatttacattaggtatatgctatccctcccctaccccacgacaggccctggtgtgtgatgttccccttcctgtgtccaagtgttctcattgttcaattcccacaaatcattttctgttttcagtgtttaccccaaatattttcatgtgcaaatttaacatataaaagcctaaagttatacaatatttttaccatctttcttctaaaccaaagatccttagcatgtgttacctccagccaccctactgttaacataaatgcctttactgtccagaaatatatttaaatatattaattttgatgctacaaattagatattgttgtttaatacagtaagtgtgtatttagatctacatttattttctaatttgtatgatctctgttatttccagcatcataggccttccttctcagatatttttctttattcttgaagtatagaagttatgtggtgctttagggagtatttgttttttgggtttgtttatgaagggtttgtgtctatctgtagatatcttaatttccactctaacttgtagaaaatagtttttttggggagtatctttctagctttataaacaagttttttccttctctcctatgtctctggcttccattattcttgaaaagtcattgtcattttaagtgtcagttttttgtatagagtatcttttctctttgacttcttctgtaagttctatagtttcactaccatttgcctcattgcagacttctaaaaaaatgtatccttgttgttctttgagattcctaaaaaggcaaattcacatcattaatcaattctggaaaagtcctagccattactttctttcaatatcaacttctccctctcatctccctccaaaatgttttttctttctcctgtttttgttaaactttgtacctttcatctcctggtcacttcgttcctggaaacacacattagtgggaacactaatttgggatcaattaaaagacaatttcagatttgaaatttcagatttcagttcaggtattttgaattatattggtattgttagttataactctaaacttgtttaaatgttgaattatggtcagaagttcttagaggaaactttttgattcttctcccattgtcttcctatcagagtaattttttaaacttagtttatttgcagagtgtgttgccttttgtgggggcttgtatggggttttaatgtgggttttaaatttaacctatttgctgaggttccagattttgcttcttatccctcaagcactttggtcattatatcctaaatctaggtcaacagctatcaaaagatacctccagggtaaatgccactttcagcatttgatatggtaagcacatatggattactattttattatagtttctgacctccaaggaatatagttgctttctcaccacctaagcaagtatttaaaaaggcatttcaaaaatatgtcatctaccatttttgggacatacttatctgaacatctatcatccgtattgctttattacacagatttaaaattttattattgaaatatgaacccattatttatataaaccctttaaaattattttaaaaatattgatgtatgtatttaataaatacataccctgcctgtctcctttaagatttcaaaaaaatactatatataaactatagcattatcaaagtatggataaaatatcaaaaaccatacagtagaaagtaaattatactaaagcttatgcaaataatacttattaaaatagagtgttgaacttaatagatttgacttaaaagtgtggctgccaaaggtaataggcataaggaaacttaataaggaaaaacactcagataccaacacttcccagcatttagcttgaaaagctgtgtgtcacaatgtgaagcgacattttgaaagatataatagacaatagcttccaataactttataaaacagaggaaacagtaattacatggctatttttaacttttattctcaatgtccatcagataatttgaaattaacattcattggggacattattacaagttaacttaatgtggaaaaaggatgaagcattctgatgattttctttaaaataaggaaacatcatggaaaattagataaatttattattagcatgtatctgaaataaataataccacccagtctattctccaaaatattaagatatatgtatttaataaatacataccctgcttgtctcctttaagttttcaaaaatactgtatataaactatagcattatcaaagtatggataaaacactctttataagtgttggaaaatagttaattttagattaaacattacagtgaatttctcagttgtgggcttcaatgagttaaattttaaaactatgcaatcccttttttttttttgagatggagtttcactcttgttgcccaggctggagtgcaatggcgcaatctcagcttattgcaacctctgcctcccgggttgaagtgattttcctgcctcagcctcccaagtagctgggatacagatatgcaccaccatgcccaactaactttgtatttttagtagagatggggtttcaccatgttggtcaggctggtcttaaactcctgaccttaagtgatccacccacgtcagcctcccaaagtgctgggattacagatgtgagccaccgcccctggcccaatcatacgctattaatagcatattttagattgaaaatcctaagaaaaaccatcagataacaattttatttatcaaagaatggaggcaaccaagatatccttcattaggtaaatggataaacaaactttggtaaatccatatgataaaatactattcaatgataaaaagaaatgagctgtgaagcctcaaaaagacatgaaggaaacttaaatgctattgctacaggaaggaagccagtctaaataggctatatactgcattattttgatgatataatattctagaaaagatgcaattatgaagataaaaatagatcagaggtttggggaggggggtggttaaatatatgaaacactggggattttttagggtagttaaactatcctgtataatattgagctggaggatacttgaccctatgcatttttaaaaacttctagaactctataacacaaatggtgaacattaatgtatacactttaagaagtcagggtatacctaataaagtgcaaaatgacaaaaactattaaaatgtataaaacaatctcactgatgggggtatagatttttttattttgttttgcttttctttttaaactgacctaagtaattttggaaatgaagggagattgtcaagagtaaagccaaaagaaactgtatataactactaggttctagttgacaatgttggttctcacattagaaatttaacaattatgaaatcactatacttgtacatggaagtggaacaaataagtaaatgggtggcagatggtagaagcgaagcttctcactgttaaagtgggaagttacatataagcaaggaggaaggctagaataaaccttgccatactggattagagttggatggatcaatatgacttcatgtttagcttaattagatactgatagatatacctagcaatatttataggtatgtgctagtatgcatgtgagttagtgttcatgcatgtatttcctaacactgtcccttcagagggcctagaagcgatgataccccattagcaatgagcacatccagcaccaagatcttggtttctaataccatcctccaacgaaagaaaccagcactccttagtgaaatgcatggttatgggactaggacagggtatacacaagatgagactatcctgtcttgtcttgtggtaccagaaagtaaggatgtgctcagtaaagaaaactatgaaggtttgtccaaaggacacggaagacaactgaaagagctccgaatattcaaagctggaacaagttgtgcaacagaataaactgtattggattataaccaaaagtgtaaaataaatatctatgagtttgtacttatataaatacattattgaataattaaacaggtgggggaaatagacaagttttcatgcagaagaacaccaaataaattatgtagacactgttccatcaagatgttggattataactccttactgcttatgtgcagactacacactttgatttaatttcaaagagtagagtaatggactgggggagagatagtaattgtacgttggagaaatctgacaagcactaccttaggcaggtgattagtgataagtcatgttacctttaatatgatgtgctgagaatgattatctctctggtttttgtctccaaaatccactaccctagtgtaaccatgtgaaaaacttctgaagaaatccaaatgaagcatagagtttagttcatggtaatttatcaagatggattcattagctgtttcaaatatatcatactaatataagatgccagtaatatggaaaaatgggtgagaagtacaaaggaactcattgtactgcctctggaactgttttgtgaatgtaaactattctaaaatggaaggctcatttgcatagaaaataaaaggaataatgaaactaaaatttgggatattgattacttctggcaggggagggaaagaaataaggcacatggaggcttcaaaaagattatcaatagttcataaagtgggtgatgtttacatttttattttttatttttatattcatgtatacttcatgtatgattttgtatgttgatatgccaattatttataaagtaacagtcgcctaaagaatacgtgatacagaaatggaagaaattctaagagataagtttatcagagaggtttctctgggaggtaatacttaatcatttggccaaataaataattggaatgctaaagctataattgatttggaattgaagatggagtatgacattgcaattatgtgttatgcccagtgcctttgtaagaggaaagatagaaaggttgtctttcagaagtgagaaatttatttggcagggcatttgaaagggtatgctttgagaattatgcatgttaatttttctcataaaagtgaataataatgctcatagtgataataatagctataattcatgcctattatgagttaatcacaagttgactgccttccaattcttctcaaaggctgtgcatggataattgataatcaagagagatgttcgataaacttattgcctgttgttgatattattactcttactgtacataaactgcgatagactgactgatgccaccactaaagatatccatgcattaacccccagaacctgtgcatgtgttaccttacgtagcataaggaactttgcagagaggcttaagttaaggatcttaaaatggggagatcatcctggattatctaagtaggcccaaataatcaaatgggttcttgtaagagggatgcagagggaatgggaaaagatgtcacagatgtctttggcaaaagatgtcacagtggaaccagaggttgaagtaatacgccttaaagaccatggaaggggctcaaatgcaggcatgtgggtggcttctacaggctggaaaagacaaggtaacaaattctctcctaaagtctccagaaggaatgcagtcttgctgacaccttaattttggacttctgaattccagaaatgtaggggattaaatatgtgctgtttcataccactaactggtaatttgttaccctacaataggaaactaatacattatgtcatgaaacctcaccagaactctatagattggaactcggattcctcaatttacagataaagaatcagagtctcagctaaattaaggaatgtatttgtattcagcttctcttctctgttgagtggcaaagctgagatttaaatcaaagtctctcttcctctgaagcctataccctttcagctctaatactgccagattagtgcagtggtcctggagttaagctgtctctattggaatcctactttactacttgctgggtgaagttagttaacagcttgggggaagaatagtacttttttttttttttgcgtcagattcatgataaaatgaataacagtacttaacctgcattattgtcaaaacaatctaagtatttagcagcataccttcatatctactgaaatagcctgaaggtcttttaaaccagaaatgtccaaaattgaatttattatccaaactctcaagctaccccacctccttcctatattacttctccatctttttttttttttttttttttttttttttttgagatagagtctcactctgtagcccaggctctagtgcaatggcgggatctcggctcactgcaagctccgcctcccgggttcacgccattctcctgcctcagcctcccgagtagctggaactacaggcgcccgccaccacgcccagctaattttttgtatttttagtagagacggggtttcaccctgttcgcaaggatggtctcgatctcctgaccttgtgatccacccgcctcggcctcccaacgtgctgggattacaggcgtgagccacagcgcccggccagttctccattcttatggcttcatcatcttacattctctgcatctcgtcttctcttctgacctcctactagatactttgttatccatgacgcccccttctgctgcacacacatgctagaaatctaattgttcacatgtgaaattcttcacttggaatccaaatatagttatcatgtctcatttatatggtcacacctctcccccgcttctctctcccacagtctagaggaccctcccgctgttattaacagtattttcaacatctcagtctttaccttccccttgatattgtcgaagataattttcttcaagaggattcaatttacttttgctttcaaatgctagatgcctcactgccctttatgttggtgctgaagagaggcctggtgcttgtttgctctgcagtgatgctattactggtttagtcccaacacaggtcacacgtgcctctgggctcctgcttcagggtgatagcttcactggttcacatcatcatgctcagccattgtttcctagaactgcacacaaaagacagagcggtgggtcctgaatggtcacagtcttaacccttgtctcttctagagccaatcagagccaacccttaagttccagttctgagtctaagaaacaatgcaggtacacatccccatccccaatttttggtgagttccattttagagccctttcctttctttagattccattctggtccacagtgccagagcttctgatatttgatcagtgtaaaatagatcaacacttcattcctaagatgttcaaggttgtattcagagaaattccgcattctttatatatgatatcttcaacaattttttttcttacacttcttatgcacaccaagagatattcaagaagagtagctaaaataagccaaataaatgatcctatcaaaactttctggggacggtggttacctagtcaccttatacaaaatcccataaaaaaaatctgctctaaggttacatacatttccaaatatggacaataaataggtgacaaggtttctaaaactgagccttattaggcattctgtttcaccttgtcactgtatcacccagctctgatctctttcttcactgtcatattcttcattcaagtttgcctcacctctcacttaagaattgcctcagctcctagccaatcatcttgcctccagactctccctttttttgtctacccactactttaacagttctcgaaacaaacataatggattatttgcttttttgtttaaaagcccttttttacttctcattacttctggaatcaattccaacttacttcaatttattcaagacaaggtcctctagaaaggggctacaacataactttctactgttagctcccaggaccatcatcctcagatacccatatctccttctatgtactaaaatccattttctccaaagtatgtatatagtaataaaaatctacttttaagacggaaaagaaggcaagtcctttctttctacattggtagtttacatattttatgagataattaacatatggatttcatatgtaggttaaaatgcgttcaggatgaaacactgagttttacttgacaaaaggtattgtgaattggtgtttctcaaaattcaaattttatgaatagtacagtgaaacagtaaacatgttctaaggctgtgtttaacattgaaggttgagagttctaatttattttgagattacgaaaaagatgtatatttaaaatacttattttagaacaagattggctggcatactttatgtatacagatttagaattttgtaaattcatatgatacagcaataagattgtgaatgaacaaagatgttagttcagtgcacatttttctttagattgttttatttgattctaggatttttaaaaattggcaatcgttacacatgatgaactattcagaccccttaaaaacatatttaaatggaatgaataaaactatggatattgcattcctattagattttacttgctttaaaaaagcatgtagaacaaaatatattcaaagatttacataagccagaaacttaagaaatagtttgagattaaagactatttcaaatagacagtatttttccatttgatctattaaattttcaacaataaatttcaattaaatttggtcattccaaaaacattggtcaagcatctagtatgtgtcaggcactgtgatcaatattggggaaaagagaaaaaaaaatctctttattattgaggagtatgcagtatactcccatgtgggtttagacagatatttgaacaaatattcataatataaactaataattcctataatagaatgatataaaaagtatttatgcaatctcttttgtactttagatggccatcatatttttgtttctttcctattaagttaatggaaataaattacaatgcaaagaagattagttgtgttattgaattgacccacggaaaaaaaaacattatacagaattgctctgcttgttgcttatgttcaaggcaaacaaaggtaaaatattatatttaaaatagccgtagtacatacagaattctcaaaaagtaatttaatgataaatacttctagaagtagtgacctcctattttcaatatagcatttatatactctattttaatttgctttttcaagttattagtggctttttcagccattatccagactaattttggtacataaaaggtataatcacagtgaaaattgacttttttattcaacagaaaaaaagtgttgtgagctattttccgtataattcattaaaattataacttaacagttttcccttttcaatattctttcaaagttagcatttcagtctaaaataaaagtgagcatgtaggacattaattgtacttgtctgaaatgtagttatctaaactaaaggctttaaaagaattattttccattccatatattaaaaattcatcttctcaactcatttaattactgagaattttcaaggacttttaaattatgtttccataaaattcaccacatcttaggatgagtgtttatttcttattccatgaaacgtccattatcagcataaaccaagcttgcaaattagaaatagtaaaaacaactttactatttgcattccattatccttgtacatggttttaggcttaactagagaaggtatctgcagttctcttgataattttttttctctgccatcactcatctagatatttatgtgatcttaaagtggttatattagagagagaaagagagagagagagaaagagagaaaaaaaagagtactggttttggttagatttgatccaaagacaaatttttagaaaatgaagctagaagctaggggtcttgaataaattggcctcacgatacatagttaagctgaaaagatttagaatttgaattcacatataatatttactattgttggaataattataatgagcacttagagatatgttttcttttgataagctttgtccatgtatcccaattaatgctggcttggtatgatactaaaacctaaaataacttattttgagcctatgtccttattacaattctagaggaagcctcttataaaatgtgattagaacacagtcatcaaagcaggggatcatttaaaaaatgatacatgcaaaacttagatattctaactttagtcataattgcatagatattacaacattcatcattcttttgatttagctctaaacccgatacactttctctttagtttgggggactcacaaagactttcttgactaagccacatacctcatacattgtatataaattttcattttgattttttagagtgggatacatgactattagaatcaattttaagatacaatcctaagtttttattatttcccaaaacatttcatagttgtcttatgcatatctgtttttccagcagcgcatctctatagagacttcccaaagcattcaaattaataccctagagctattacttccatttctcgttctagtacatttgctcactttacaaataaattatttaagcacaataaaagaaaaattggtaatttatttggggaaacagaggctactgattctggatgcccaaaactcactttggagtaagtgagcatcagtgagtatataacattttttctttcctgaataaatacattaaaaagaggcatttttatgttaagcaaaagttaatgtgttgagtccattaaagagataatgattaatttttttcaggagcttagattttaaaatatatgtttataagagaaaatgtaatttcctaactctttctactttaaatataatcaattctgaaagtaaatatatttaaatacactatgttataaatgaaagtttatttaaatgcataaaactgtgcctacattattttaaaatatggatacgtatctatttttgagattcagtaaaaataagaaacaaatgcagtaaattccaagatggcatttgctatttttcagcacaaataaaactatgcaaattttctgtttcaaacgtaaaatgccagtttttgattttatttatgttattattttttaaaatttcaacttttattttacatatgggagtacgtgtgcaggtttgttacatggatatattgcatgatgctgaggtttaaggtatggatcctgtcaaacaagtaataagcatagtacccaatagatagtttttcaacccatcacccttcccccttcctcccccctctaatagtctccagtgttaattgattccatctttacgtccacatgtgctcaatgttgctcccacttacaactgagaaaatgtggtagttgcttttctgttcctgcattaattgtcttaggggattatggcctccagttccaaccatattgctgcaaaggacatatggtttcattctttttaatggctgtatagtattcttccatagtgtatctgtaccacgttttctttatccagtccaccattgatgggcacctagcttgattccatatctttgtgattgtgaatagaactgtgatgaatatgcacatgcatgtgtctttttggtgtaacaatttattttcctttgggtatatacccagtactgggattgctgtgttgaatcgtagttctgttggaagttatttgagaaatctccaaaactgcttttcacagtggctgaactgctttacattcccatcaacagtgtaaaatcattcccttttctccatagcctcgccagcatctgttattttttgactttttattaatagccattctgagtagtgtgagatggtatctcattgttattttgatttgcacttccctgatgattagtgacgatgacaattttttcatgtctgttggccacttgcatgtcttcttttgagaagtatccgtccatgcccttcgcccttttttaatgagttatttggttttttgtttgttgctttaagctccttatggactctggatattagaccttgttgatgcatagtttgtgaatattttctgccattctgtaggttttctgtttactctgctgatagtttctattgttgtgcagaagctcagaaaaagagcttaactaggtcccacttgtcaatatttggttttgttgcaattgcttttggggcttagccaaaaattctttgccatggctgatgtcaagatgggtatttcttagcttttcttctaggattcttatagtttgaggtcttatatttaaatctttaatccatcttgacttaatttttgtatgtggtaaaagatagggctccagtttcattcttctgcatttggctagtcaggtatcccaacaacatttattcaacagggagtcctttccccattgctaatttttgtcagccttgtcaaagatcagatagttttaggtgtgtggacttatttctgagttttatattctgttccactggtctatgtgttcatttttgtaacagtgccatgctgttttggttcctgtagccttatagcatagtttgaagttggagagtgtgatgcttccagcttttaatactattgcttaggattgctttggctattcaggccttttttggttccacatgaattaaaaaattttttttctaattctgtgaaaaattacattgatagcttgatagaaatggcattgaatctgtaaattgctttgggtagtatggcaattttaattatattgattcttccaatccatgagcatggaatattttttatttatttgtgtcatctctgatttctttcagcagtcttttgtagtccctttgtagagaattttcatctctttggttagctgtatttcaaggtattttattttactttttgctattgtaaatgggattgtgttcttaatttaactctcagcctggatattattggtacgtagaaatgctactgatttttatacgttgattttgtatcctggaacattacaaaagatgtgtatcagttctaggagtcttttgcgagtttttagggttttccatgtatagaattattttatcagtgaaaagagatagtttgacgtcttcttttcctatttggatgccttttatttctttctcttaacttactgctctggcaaggacttgcagtcctatgttgaataggagtggtgagagtaggcatccttgtcttgttccagttctcaagggaaatgtttccaacttttgcctgtttagtataatgttagcttttggtatgttgtatatggctcttgttattttgagtcatcttcctttgacacctagcctgttaagggtttttatcatgaagggatgttggattttatcaaatgcttttcctgtgtctattgagataatcataaggtttttgcttttaatcctgtgtatgtgctgaatcacagttatttatttgcatatgtagaaccaaccttgcatcccagaggtaaagcctacttgattgtggcgaattaactttttgatgtgctgttgaatacagtatgctagttttttgttttttgttttttttttagatggagtctcactctgtcacccaggctggagtgcagtaacacgatctcagctcactgtaacctcggcctccctggttcaggcaattctcctgcctcaacctcccaaatgtctgagattacaggcatctgccaccatccctggctaattttttctatttttagtagagatggggtttcaccatgttggccaggctagccttgaactgctgacctcaggtgatctctccgccttgacctcccaagtgctgggcttacaggcaggagccaccacacctggccatagtttgctagttttttgataagtatttttgcatctatgttcatcagggatgttggcctaaagttttcattttttggtgtgtctctgccagattttggtattggatgctggcttcatagaatgagttagggataagctccttctccctgacaatttgaaatagtttcagtgggactcgtagcagttcctctttgtaaatctagtagaattcagctgttaatccatttgggttgaggcttttttttttttttttggggttgatagtttttttttttaattactgattcaatttcagaattcagtattggtctattcagggtttcaatttcttcctgattaaatctggaagattgtgtgtttccaggaatttatccattttctctagattttctgatttgttgcatatagaattgtttgtagtagtctgaagatcttttgtatttctgtagaatgggttgtaatatttgtcatttctgattgtacttatttggatcttttttttctttgtttctctagctcacagtctatcaaccgtttttgttcttttgaagaactgttgatttcactgatgttttgtgtgaatttttacatctcaattttgttcagttattctccacttttagttatttcttatcctgggattggtttgttcttttcttctagttcctttaggtgcaaagttcagttgttaacttgagatctttctaacttcttgatgaaggcagttagcactaaaaattccctgttagcactgcccagagattttggtaagttgtgtccctattttcattaatttcaaagaatttttaaatttctgccttaattgtaatgttcacccaggagttattcaggagcaagttgtttaatttccatgtgtttatgtagttttgggagatcttcttgattttgctttctatttttgtattatggtctgagggtaggcttggtatgaattatattctgttgaatttattgagatttggtttattaccaagcatgtggtcaatcttaggatatgttccatgtgcagatgaaaataatgtatattctggttgttgggtggagtgttctataggtgtctactagttctaattggtcaggtgttgagtttaagtctagagtttctttgctagttttctgcctcaacaatgtatataatgctgttaatggtgtgttaaagtttcccactattattgtatagctgtttaagtcttttcataggtcaagaagaattcattttataaatctgagtgctctgatgttgggttcatttatatttaggataattaattcttcttgttgaattgtaccctttgtcattatataatggctttctttgtccttcttaattgttataggcttacagtctgttttatctgatataagaatagtgactcttggtcttttttgttttccatttgcatgatagatatttaacttcatgtccactacaaatttggttttacccatatatttcatatttttactattagctgtctttttataaataattgcctccttaatgcagttttaaacataataattgtttagagaagcctgtgggtgttgttatgtgtgagataggtccctcgaagatagcacaaggttgagtcttgtctttttatccagttcttcactctatgttttttaactggtgtgttttgcccatttaaattcagagttaatattaatatgtgacttgtttatgtcatcatcttgttagctgattgttatgtagacttgattttgtagatgtgtgattttaaaagtcatttagtttttgtataattaaatacatgactgcttctactgctactaaggagaacaacagaagctaacattgctatagcatttaaactaatttaaatctaatttaaactaatttaatcccttatgataattttatgagtgaggtactattactatgaccattttgtagatgatgaaactgaagcacggactaactaagtagcccaaagtttggggcctttaactttgtaagtggtagaggcaacatttaaaatgagggagcatggcttcatcatgttctaagccattaccacatttttacaaaatatggaagcaaattccatgtgtttgaattttaacttccaattgtcttctaccaaacttgtatttactaaaaagattaattttaatcacctactaaataaatccatgctagccgacttaattcattcagtcagaaaaatcaggttgtttagtaagagagctggtttaactttaattttttaaaactgtattgactatttgactaaattggctgggactacatgcaaaaacaactttgttatgaattagaagcttgggaacaagcattcttgctgagattccttagttagtcagttaatcaataacatttaccaaatgcactctgaggggttgggaaggtgaaaaagatatattagacatgtagtctcagacgataaagtaattacaatctagtaggaaacttatattcttgatctctaaacatttgaatttgatggttgattggtgatattattctgagatctttaagatacattacacagatcatatttttaaataatttttttattttactttaagttttagggtatatgtgcatgctgaaacgtaatgtgtatatgtgttatactctggttgtttttctacttgtttgatcctgttttttttaatgaatgatagttactcccagaaaaataatgaacacctgtacatataatttgaaaaagtaacacatattgtaccttttctttcacagatgactaaaacaataaaattaaacttagacaagcacatcttttattatgaataaacgttgttgagaatgggtttcaaactgaccaaaaatacttctaccttcgtttacatattcatgcatcattttcaaagaatatttgcaagaacttgagagaatcttcccagtgtttttttaaaaaaattgaaccactttttcttttaatgctgacttagtaatactttcaaacacccccacccacatttgactttagagaagacgttttagaagaaggggaacattttttgctcactgcaagtgtcatctgactatttttaaagatttattcatcattcattcaaggtagcataatgtcatgagaatgccagctttgaaattagtaatctgtcatgtcttctactggccactcttgcagtttgattagatgcaagtttgcttctctttgaacatttcagtttattttttctaagaaatgattatattgttcaagataaagtataaaattatgtagctatcaggagtatttattgagatatataccactgcagatgtgagaaattaaaacatttttatggcaagtatcttgacctgaaaaagcttactacttactgaagatagatggaaaaaatcaatctttatttttaagaaattactattcaacctaattgatgagtaagcctatggcagatattggtgcatattaaatacaggtattctcagaagagttacagaaccccaaaccaaattgttccctccctatatggtcttcagttgtagtttttgctttccgttaggaagatgattataatttaaaacatgttcatcttatgaaaaactgtttttcctcatctgcatgagaagattaacaaaggtgaagaatactgtttctatgacacttgtaggtgcctatattccaattgctaattatttttcaatctgatggaaatgcgtaaggatgaaagagctgtgttgctagagtgtgtttcattttgcttcagtaagcactgaaaaggcagaagatggcagggtaggtctttaaataggtgatttaaaaaaaatcttcctctttgtttttcttctcctaaaattacagagcagacttcattttatttcctagtaaatattccactgccagagttagctcatgttttgttattaactcaagttgttcaccagtttgcttgttcaactttctctaattcaggagattttatgtcgcacaggcttggagttttcttgattgccttgttaatgctcttatttcctagcaatcaatttagtttgattgatatttgttatgcagcctagttagttccttcacttgaatttcatttacaggtttttttttttaacttacttccttagcaatcagtttgtcttgattgctatttacttcctgacttcttgatattgcaagactgcataaacgtcctaattacctttatgtccactgcaaatttagttttactcacatatttcatatttctgttattagctgccttttggtaaataatagcctctttaatgcagttttaatgcatttgttgtgaatatagacaatggtttgaatgtatatttgcttacttctaacttagaacataaaacatgtatatattatcatgagatacattataactattataaaaacaatcacattagatttaaaaacataaccagggcaaaaagtgaataggtacatacaggtaaactgtggagacagccttaggctcccttagaacacagcaagcttaacctgaacatcaggtttatctctcaccattgggaattaaaaaacacaaaataccaaacaaaaactaggtcactaataatgttctctgtttctgagagtaatttcagacagcactgataaactgaataatgtcttcagtatttccgagagcctgaagcaaacgtctcccaatttaaattgcttcaaggtgaagcagaaacttccttggaatgccatatttctaatagttccctaagaaaggtaattaagtgtctattagattagaaaaaactgctttgcttaattctatgaaccgttgtatttattttaataaatattttaaccatcaaataatcctacaatgtcttaaaaacatgaaaaattaattctctagagggccccattcagtggctggtaaatagtagatgctcattcaatgtagataaactgttcttggatctattttacaatttaagacactcaagctgtgaatctttgcatgttccttctccacatttaggtgagagaatgtttcatctgctctctaccttaagcagactgttgtataatcctgccttctgctcaatatttatggagactagatccaatgcaagcgtgattgaagaatcgtaagggaagatgttctgcaaaatgagagccatgtctctacatctagtaatgttatcagtagttgtaaaactcacaatattcttccagcaagcctttctgcatgccagagtatgcaggtgccataagagctaaaaagtttcaaatttaagagtaataaataattgtatcattgaagtaactttagaatagaggcgataggttaactggcatttgtattaggaaataagagggtggtcaaataatcagagaaaacttagagaatgtgatttgttgttttcaatcaggtcttgaagaagcttatgaatgatttggtattaaagaaaagaacagtgaaacaatgttaggataacagtttatctgaaggccgagaggttaaagtgggcacaagagcctaaaatacaggaatttatgtaagtgcgaaaggacatttgcagaaaggttcagaatcattccctaagtaggattttaccttaatcaacaataaaatgatgctttttttaatgacatttaaagctttgtagtgtatgaatgtttcttacatctcttgcctcttgaaagaaatatttttgcctacactctaccattcaaattctagtcattctctaaggcccagtacaaatgtatatatcattatataagtagttataatattatatcttatttatatgatttatatatatttatattattcttatgtatttatatttataccaacattatttttatataatttatatatttcttaaacttcttttcacctaatatattgtaaggctacaccaccagcacagagcgatatctctttctggatctctcagcaattaatcatttattctattgatgcaagcttttagttttgttgttatttttaattgaggaatactttacatacaaaataaaatgaagatcttaagtgttcagttctatgagttttataaattatacacagccatataactacatccacatcaagattagaacattttcatcactcagaaagttctgttttgcccttttctagttgatgtcccttttctgaattttgttgttataagattagtttttctggttatttatatttatggaattgcattatatatatgttatatgtgtatatctagtatcttttaagtgacatgtttttaaagttcatgcttatatttttaacttttttcctgtgtatttccaagtaatatctcatcctataaatatacagtaatttgcttatccattttcctgtcacacatttgtaatgctttgtaatgtttccaatgagaaaatggttggtgtgtgttaattgtataagcaaccacaaaaacaatcttccaaagtaattgtactattttgcactctcatcagaaatatatgagagttccttttgctccatatagtcatcaacaattgttgttgctagtctttcttactcattgtagtcttttgtaaactttctctacaaggctttaggctatttttaattggcttgcttgtcttttcattattgactgttaggagtttattatataatctggatataatctttcattagagaggtacaggaaatatattttttctaatctatggcatgcctattcattttcttaaattcttaggtttcttaacattgtttgttggtgagcaacattttttaatttagatgaagtataagttattaatttctttcttgtataattagtgtcattgctgacgctaagttcacaaatattttatgcattcttctgaaagctatatggttttgaatttcacattttgtctatgttcgtcttgggtaaacttttgtgtatagagtgagataaaggccaaagcatatttatctccaaagtttatgttttccatgaagctttgtgagtttttaaagcaaatatactaatccggctcttcatttttcttagtcaaattttcacataatagcctatcttctcaatacgtttgtaagtatattgagaaccaaaattattttttaatatttttccataactttacagtgtggattttactttgtttttaaaaagcaaattgtatttgaaacaatgattccaaatattgtgcgcattaatattgatttgtgattgattaaataaatcaaaaattctaataggagtgttacatggaacaactaaagaaaactagaaaaggaaagagtagtatttacaagatattttcttttagaagcaaccttttgcatttagattgttttcgatgttatcaaaacattagataaggtttttcgaaatgtcaacataggtagcttcctggtcaacaaagccagcattactcctttatttacacaaaagaagtgggttcacagactggcaaagagtgatatctagtgggattaccttaatgtcttgatggcatatattctcatttatttaattttcactttgctgtatgattcctaccagttaagacaggaatgtaatgtgctaattaaattattgaaatagttaagcatattatatatctttttatggagaaatcagatgtagtgtatttaggaaaccttattacttaaattcaaattcattacttctgcaagtttctctggagatagcacaacaagcagtatcttttatattctcaaggaggttagagtctgatgctttttcttcgagatggagttttgcttttgttgcccaagctggagtgcagtggtgcaatcttggcttactgcaacctctgcctcctgggttcaagtgattcttctgcctcaacctctggaggagctgggattacaggtgcctgtcaccaggcccggttaatttttttgttttttagtagatatggggtttcaccatcttggccaggctggtctcgaaatcctgacctcaggtgatccacccgcctcggcctcccaaagtgctgggattacaggcatgagccaccacgactggccagaatctggtgtatttttaagcatcatatgtactcttaaacagtgtgttgtcctctacatgacacaagtgtatatgcggatgaaataatttagctacctgtcaaaacggtaattatttctagcaaaaaatagcaaaagataacctgttttccaagaagcccaactttacttttgtgaatgcctgaggattgctaagaggcaataacattataagtattgctaaagtggcaggctgtaaatagagctgactgagcaaagttgccatgggaaacttgtagacttttccaaaaacggaaactgaaccaaaagcattgatagtagttgaagtctggggtctgagagaaagtccttctgcctcctattgaatgtgcctaccaggctgctagagaataggtgggtttgtggacatatgctctgcttatctatccctttgcaaattcccttatatcagttcaccttcaaactcagcacgtcaggtaatgaacactgagaaatgaaaaagaagtttggaaatggaaatgaatcttctcatggaaaatttgtcttgaatttagcccgtaaagggtaatctaaaatggcttacagagaggattttataggacttttttaagttgccgatagggtccatgtttggcgtgctctctcctgctccttcatttgttttttctttcacgattgcccctgctaatactctccctctagttacaaaatgaaaaacatgtgacttgaagagggtttctttcctgaggacaaatgagcaacacttgaagtggaataccaattttttgaccctagccagcagtgcctgatcattccctcgcgtattttagcaactcccttgcctgctgaaccactaacatagtaaatagtagaatcctgctctcaaataatggccagaaaatgttcaattttggtttccttgcacaattcactaatacagtatatgtttcaataattatgttttacaattaagttatatcaaaactcctgacaataattgataaaaaaaatggaaacagtacattttggaaattaaatgtaggagctaattacttcaaaggacattgttgacagatttcattttaatgtagaaaggatatttattattttggtttataagtctttgttgagtttattaagcaatttgtgttgagaaagaaaatgtgaatctaaagatttagtagaacaaagtattaccttgttataataaaaatcctttaagttaaaatttaaggcgtttctaatttggaacctcatttctgagctgttcagatttaactgaatctatttttaaaaaacttaagtagaatatagcacattatctcttcccacccttttttaatgagtagtttttattgattgatgaaacaggagttgtgttagaaatattatgtgtatacttttaggtaactgagcaccattttgatatcaatcacattttaagagaaaataattgcttatctttaatgagagtttcttctattactgatttttattttaaaagtacaattttctgacaatagaaacatttttcagataacatgtacttatactatacactgcctgccaatagattttgcctttcctgattaataatgttggcttgtgaattctaaattccaaagggacatattttcacaaacagaatcagtgacatattaaaactatacggggttaactcataaaatgctctcacaaaatattaccaatagattctattccaacttaaacagaaacttaaaaataagttcacattatggacaaattaaatagatgaacttaatgattgaaatggccttatacttttataaatagatgaaaattaatggaaaaaaatatattaggtatgtattaatgaattaattttcaaaaacagagtttttgcttcataatgactacatatgtaaaagattttgtagaagttgtactctaagtgtaggttaatagacactaaattattttcaatagacagaacttagccacatgatcctgaaaacatattctaggaaaaatttaaatattgtgttatattggaaacagggaagaattggaagaatgggaacaaagttatttatttaatgttaagattcattactaaaaattaaatatttgctgacattatagttttatcataaaaataaggatagtgtaacaatatctatgatataatatatttaaaatcatgtatttaaacatgttgtgaaagaatttgttccctatactacaaaaggtttagttaagtcatattaatgaaaataattcaaatggctcctataatgtatattttgagtgaatacatttatgattataaatcaccttaaatttttcctgtaaagaaagcaaaatgtatctgtgggcttaaaaaaaatattgatcacttaaaatgaaaactcttgtgagaaattcttgagcaatgttggtttcaaaggctctttgacttcaggagaaagaatatagaaggctactgaatttacattttccattatttattttccaaattaattaatagaactagatcccaccttctttatatttgggttgtattgaatattggatgaacatatggagagctcagatttatgtaaactcacctaggaaatatgaatgaatgatgaccattaactctcaccaacacaaaattattttttaaataaaattatgattataaggtattttctgagattcttgtatattaaaatctggcataatggtattggtaatgaaaacaatgtctgaggttctaactgaccataattgcacactctattgtattgctagtgaaccgtttagcagattccattcatcttagaagccttagattgattaaaaaattaatgattgatgacaattaagacttagactctataaaataagatgtaaacatcatgggttgctgattatttcttttttgctatttagaaatgtagaagaatgcttatttaatatatacaagttagattatatcaaacttttctgtgccttttgtttctgtcatatggcattgaaatattgtacagtcctatagtaacactttaggatgttatattatgaaatggaatactgtatattttcaaagacatattgtaatataaatccccaatatctatctgaaatttaagaaaattgttttgagaggaatatcatttgtcttaaggttatatatgtacttaagagtgttaatagtactttgtttagtgtttttaatgaaagatggtgtgttgaaatatgcaggtctagaagctttaaaattagctgtaatataatgtgtttcaaaaaaattaatattgggctgggtgcggtggctcacgcctgtaatcctagcactttgggaggccgaagcaggtggatcacctgaagtcaggagtttgagaccagcctgaccaacatggtgaaactctgtctctactaaaaatacaaaaattagccggatgtggtggcaggtgtgtgtaatcccagctacttggaaggctgaggcaggagaattgctagaacccaggaggcggaggttgcagtgagccgagatcgcaccattgcactccagcctgggggacaggataagactctgtctcaaaaaaaaactaaaaataaaaataaaaataatattcaaatggtctgaaccatgttgaatgtaatagtgtcattgtttggttggaacatgttaaaatgttaagatttttgtcaaggctgcagttgtacatgttgaaactaatgaagaatatggtgattctacagaaaatacagttaaacatttctgtcatgaaccttctatagtcatgtacaatattttggtctggtacactattgactcaagtggaagtagtgattcaacagcttactcttttaagtatgtctttggaatcaggggactgagatgctattcttggaatagagaggcatccattatatggccctcatagcagtcaactattttctgagtaaaatagtgattataagacatttttctgggaattttgcaaattacatcaagattgccaggttaaatgtaagagctagggactaaattttgatgttataatacacaaaagagggatgggttgttcattgccacaatattctagtgacagtaaaccctgacacctctgtttccattctgttttagtagaagaaaaacgtgagcaaattgaaggaaatccagaaaagttttaaagatgagaattactcagaatacacagatagatcaggaaatgaataagacagttcaaaattagtcaatatctgaaagagaggaaagcactagttaaggaaagaaattaatgatttgaaatttatccagaaataataaaaataatatgagaaatatgtgggcattattattagcaaaaactaccttggtaatgaaacttgagtaataaaagagaataatctctcatggaaagataatgcaatttctcttcatttagagaatctgaaactcagcaagctaaaccttcagcagcagtgccaatgtggtaccaaaaggactagataaacagtgagccttagatctagtattcatggttcaataaatactttcaaataagtataatccgttggcatgtgctctttaagatatgcaatgcgttagaattattggcactatttgaattatatacactattgtgtttgtaattttttggttcagttaagttataattagggaactttagatctcttactgtcaagtcaaaattcaggagcattgccggctggttcaaggaacatctgttacattaaattttatgattttcgcatgagttattgctctatctgttgagagtgtcttgtttccctcgaatttaactttaattttaaacatttgtagaaaatgtttacatcacaataaagttgtacataagatttaaacactcataatggaaaatgaattgtgtgttgtcactcatgtctctacatagccaaaagtaatgtaaataatggtacaatttttgactgttatatagcagttttcagaatgcaacttagacttgttttacacatattggaaaaccaagatgaatttttatttcagttaaatactccctggcatcggtgtccaaggcctaagagtgggattggggggtgagggggacgatagattcttcctgattctataataaaatgactcagcagttccctgtgagcttggatgtatacacatatgtttgtgataaatcctctgactatatttcttacatacagagtgaggagcaattgaaacacatcaaaggaatatgtgtccttcatcagcaaaagacaagaaaaaaggatgatggacaattttcattttacttggggcatgaaaatcaagttacttaatttttttttatggaaggagtgtttatactgctcagttttcaaatctcaatcatatattttattatgtctggatatgttacatttcacattaaagctatatgtttagatataaccaaggaggcatcattataaaccatatttctagatgcctttcttccctacttggggtgtcttggatagagctgaagcttattcatgtaaaccattgatgatgccttaagccatacttactcacaaagaagtgtagtgaaaataaaacatcttaaaatatttgtgattgaattgatgggtaatatgaaactgattcattcattggaataaataggaaaagaagttttaatgattcatgagaaaatggaagttaggttcaattgttaaccagaaaaggatgttgtattctcaaataaaggcacgatgataaaggagcctatacattgagagggacagtctttttaaagcaagacactttaacatccatttggtctcttctagaggaagcactctctattaaaacaaagattagaatgattttaagcctatacatgtcaggagaatgagatattttttgacttgttattttggctaacaagtatattttcatttctgtgattcctcatttgcaaactgattaaagtggttttagtacagtgtttcctgtggtcacgtaggactgtcttaggctgactcagaatctatgatccaggcacattgttatcgtagcatttcttaaactgcaaaagtaacagatttccctactgtaataattctgattaacagcgtaagttctgagacaggcctgattctaaatgtcagtcatgacctcttatatcctaatcattacacagttcagtagagaagaaaagtagttgaatttgtactcagacatgtgttaagtacagaagccaccagaggtgaaggtctatccttcagagcagttcaaaagagaaaacatccaagagctctgagcctgcatattacgagggaggcttgacagatgtacaaagaggaactttggctaaatacaattcaggtacagtaaagtataacattacttctcatcactaaaatacaaccaccccatgtcctggaatttgatgcacaaggttaaaaaagcaaaacaaaacaaaactttaaaatgtagaactattttaaagaattatcataaatcagaactctccttcataaaggcctgataatttagagattatcatctatgcaattgtgttgttattcaaagtaaattaactcctggcttatagtacagtattaattttgcatgactggaatcacattagagaccatgttactcctagcaacattactactaacatttacttggtgattttatactaatttacctggatatccttatgagtaaaatgcattgtacaaatacatgtaaagtagaataaactcctatatttgtgaataatttcttccataatgtattagacaaatttcaaatttggatttagaaagcagcttattgaacaatctaattcattttctcttaaacttagtttatcatcaccatatcctgggtcattatcccgtattatattaaaaaaagagttccaggcttcattaccaacctactgaatctgaatctacttagcagaaggggtgtggcatggaatcaaagaggatggaatggaaaatactagaaaattgaaatttgaaataaatcactagattttgatgatttaaatatatagaacattatctagtaaaaaaactcattttatagatacagatattaattaattcatccatgcatatatttactcagcatttcaatgcaaatatgtaattaaaaataattaaaataaaaattagatatcatccctatcggcagagactttataacctaaagtcatgagttatgtaagtatttgcgtgcaacccatgtcaacagagaataaattatcaatgtattgttagtggtatggatagcaagagttgtgatatcatggaaaagatctgaactagatatcatgattgtagctcatgtaatttttctaaaaatcagtatccttgctgataaaacgaatgcactaatttagattatttccaagattctttttagcacaataatcttaaaattatgttatttcagagaagggtgagtgtgaggtggaaggatggtggaattgtgaaaaaataggacttgagactggtagatggataaagtaggagagcgagttgggagaatgcaaagttggtggaaggagaggagtgagttaagacaaaaaactggatggtgaagtatcaagttttactaataatttcaaacatataagcacttgagagacacaggtgaataggagggacctgggactccaaaaggagctcccgaggtccgtcctttcatcaaattcacatttttggcccagagtagtagaagaggttcctctgagaagtgagttacctcacccaaagggagtattttaaattataaaacatttctattgtatgtacaaataattacatagcttatgtgacatttatagggaaccatattccacaaatgtatagaccctagatttgtttcctagaagaaatccagaaatcctaaaccatggaccacctaataaaacatttatatacattaggattcttaattcatttgcttcccgtgagaatgattactagcatgtttactagagggtgagactaggttaacctgctttctttcattctcattagtgtccccagtaataggtagaaaaatagatcatagactagcttccaaagtctttctttcccagggaaaaatgtatatgtttaggaataaacatggtatagcaagatgtcaggatctaatttgaagataaatctctattttaattgtatcaacatttaaaaaattgattggggttaatttctactgatatataactagctgtgcctcactaaagaagaatttaaagtttgaaaatgtaaaatattgtaaaagaaaagagattttatttaaaattgattcttctaactttatttcagaatacatgcttagatggcactttgtgggaacagtcggtagggagaaagaaatgactcaagattatggcacaacttcaggatcaacagaatttgattctgttcagaattttcagattcagaattttctcaacctattagtcccattctgttactgtctatattttgttaaagttaatatgcaaagtaaagcatgagatgtgcatttgttactcattttatcgctattagcttttactactggaaaaagttatcagcagttttgctgggaactgtcatatttctgaatttgatgtaataatttaaaaatatgcctttttatgagatttcaactaaaagacatcctctgtccctttaaatttattttgtggtcaccagaactcacatatcgaactaaagtttacatttgaatttttacttttcacgaattagatttttactaaactgttgcattcttaaaattactttaatgaaagttgtctctataattcatatgtatagacatttatgtattaaaggatatttatgtactaaagctaattcttgtcaacccttatacaaaatgggacttattttaattgtaactaaaagctaattacagatacatatatatatatatatacacacacactttttctaattagcctcacagaaaaatttatcacatagtctgtagggaatgtgtaatgtgctatttaccaaagtgacagcaatcaatctattatgtaattttgattttcataatagtaatttatgaaattaattaaaaaggccaacatgagatgctgcatttaggcatttttttcaattatgacttcatttttttagtataatgatttcaatatatagcctttcaataaatcagacagatgcaagttattcctcttacatctctaaaattggaaaaatatatttgagtatcaatgaaggaaataaaactgtaattttaaattacatccaattctgctaattaagtaattattgaagacaaaataactcatagagaagccctatatattccatatttttccagtctctcctcatttaatattcttatttaattatgaggtatagaatattagaatttcattactggcatctggaagcaaagataagatggttgcaggctttctggtatggcattgtgtgtgacgtgagctgactcacagcataaagggaaatgagagagagtgagtgttccttactgaacttaattgtacataagagctcctctgtagcgttgctttgggggtatctgccatagaactctctgataatgatttctcatcagtggaccaagatgccattaagtcattctccttgttaaaatctgcttattgatgagtttcacttaaaaattaaattcaggtcacttctggacaattgtcttctaatttttttgttctctacataaatggaaaataagtctataatgtttgtcatccaattaaaattttatataatgaagactgtgtttatcaaagacaaagtaactgattcaacttgttcaaaatggaccattcattgaaatgttcaccctagttatatgatgctgtagagacaaaaatatggttgacaatgtttgccttctgaaatctctgaaatgatatgatttagtgcaaatgtctctcaaatgtgtttttcttttagttaaaagtaataatgattaattctgtcatctttctcatttttcctgaggtaataggtattatcaacttgatatacatcttattacaccttattctatgctaataaacatagaaatatgtatagacatatataaaatagaagtgactttaagtttattttacaaaaataaggtcatagtagataagtttgctttctgtttttaaggtaccatgatatccctacaggtcaatagaaataattaaaatattattttaagcagccacatagcatttcataaattgaatgtaatataatttgtgtgatcattctagtgataccaatttgtgttgtttttagatttgttttggctttgctgctataaatatgcttcaataaacacatttccaactggcacacctttttctccaggatagagttccgagaatggagtttctgggtcagaggatgtatgtgttttttaaaaatattactgtattaccttcataaatggctgtagtaatttacatccccaccagtcatatgtgagatttacaatttatgtatgttcttgccattctaaatgctgttaatgattttattttattttcatttttctttttgactaatctgattggttaaaaaatctatcatatctaattattatttatatttgcaattctttgtctgcatgataccttgagcatgtgtttttgctttctttgacatattaggtttccctgtgtctgattttcctgttcttatactttagtttatacttttcttatcaatgtatagatgttcttttatgagacattaatcatgtatctcaagtgtgtgacaaatatttttccctataagcctttgtggtaggggactagctacctctcctacatcatacctttacctctataccccctgcatttacttccagctactctgatttcctgacttaactgtcaaacaagacaagcctttgtattaagtcctcaacctgggaaagctcttccacaagaaatttacatggctcactcatttcattcaagactaaaataacactgttgtaactctctctcctcatttggtgttatttttactcatagaagtagtatttctcattactgtgtattatgtatctcctgtgtgctatcacttatgttatacaatctccatgacaacaggagtgtctattttgtttactttgtgcccccgcacacccaacatttaaaacactgcctagtacacagtaaatacatatttagatttgatgaataaataatttgttttttgtttttattgatgatatcccaatttttaaaaatctaaaaatcactgaaatctctcaaataacttgtattaaaacttctggcctaggactgcattatgtctgtacttttagttagggcatttccctttccaaatctttgtttgtagtaatataggcactactcagtattctcaaatacctatcagtggactcttcattatttactagtccttagtctcacattgtaaagtttttagcaataattagatcttagagctgagcataattaccccactcactgtcctctgaggccatcaccatttacacatctcttactcttaacacttacacactccaatctcaggccctgtgccactgccgaggcgactgctgcttcctacctgttgtaggcagaatcttgttcccccaaattcatatgtcaaagacctaaccccagtacttcaaaaagtaaccattttgaagataagatctctaaataggcgactacattaacatgaggccattagggtgggttctaatttaacctgattagtgtacttataaaaatagaaaatttgggtttacagaaagggacactaaagatgcatgtgtgcggtggaaagaccacatgaggacacagagaaagtggtcatctgcaagccatggagagaggccttgggagaagataaacctgttgacagcttgaatatgaagaatactaggatattaaaaagtcgatgataatagaaaagagaaaaaagtcattgctgatgcccttctccaagaagctgaggaattctatctagctgcagcagccggctttgtaggagcaggtgtgccattaaacacggagagtagaaaggatggtgcaggttagctaaaaacagtccagtgtcaatggcaaagattctgatctagcaggcaaaggagagcatggcagaagaggaagctctgaaagtaggaaagtctaaaattagagacagtgacaaagttatgatgctaggtgatcttcagaattgtgacatgcttcctatgcaggagaataaagtagaaggcttggggaagaaaatctagccaggatgttgggagacctgcccatagactggagtcaggtactagaaagaaatggattttctaggtcaaaaatgtaaaacagaaatcttgttctagaccaagtcatcaaggaaggcagcagattggaaatactgtgactatggaaatatgtgacaatttagaattcattactgcattctggatgttaagctgaagcatctgataaaccttttaatgcaggcacatcttacggaaaaaggtagaattcatctgtgattttagtcacgaagatctgggaaatcctaggcagacatgtttaattctgttctgttcttttatttaaaatcaaaggaggccgggtgtggtggctcatgcctgtaatcctagcactttgggaggctgaggcaggcggatcacttgaggtcaggagttcaagagcagcctggtcaacatggcgaaaccccatgtctattaaaaatacaaaaaaaaaaaaaatagccgggcgtagtggtgcatgcctgtagtcccagttactcaggaggctgaggtgggctgaggtgggagaattacttgaacccgggaggcggaggaggttacactgagccgagatcacgccatagcactccagcctgggtgacagagtgagactccatctcaaaataagtaagtaaatacataaattaattaattaaaaggaactgtctacctgatatgcaaagccccatatggaagtgggaggggagtaaaatcatatcccaattttcttagctagtgtttcctaatccatctttccccatacccaacattgaaacatacatgatgccagctgctaggtgattttcctaagtccagcttccgaattacccttacagccaatgtaagataacagcaactagcaattgtgtagactttttattttttgctaaatttttttttctcattttaaaataaattatagaccacacttagatgtctgccgggtggtggggagcggggggaaagctgttctgtagtttgttgtacaagtgcagggctcctcaaaagaattaaaaagtgagtggcagcgcatacattttggggacttagtgaaaagaagtgcccttcatggtgttgttggaaatgttcctgtattcccaagtgtgccttgattatgaaagcagtgccaaaattaacagacatgttttttagcatctataagctgtatatggtaagtcacagaggagactttcaaagtggccctattgaaagcattggaagagtggcgttttagaataaaatactgttaactactctgattaaattagacatataaatgaagatgtttttcaaaagtgcttcagataatcagatacatttctgaaaaaaacagtctcattctagtaaaagcacaaactactgacacttgaaatagcaaacaatattgtggtttgatctgagaggcatttttatctaatacgttcaaacacatgaagagaaacatcacttattgaaggcctgagacaccatgctcagtctgagttgtaatttgagcatgcatagagaactgcttggatcctagaccctatacgttactcatcttataagcagcctgaaaattgccttatccctgtccttaagacaagtattgtcataggactcaagttcattgacattgattctgcagaatatttctttctctcttgctctctctctctctctgtcttgttctctctttgatctaggtgttacagtttccaataattggtttctagccccttccccaagtgatcaacacttctctttcagccacccttatttctctaacttttgtacccttaatgatttcacagttatatcctcattatcttctcacctaccattatataaactgtattcctaccttgtccttaaattaacatgcacttatgggttttttttagccatgcatgtttaattcttcttataactgaattaatatgtggaccagccttctaggagcctgcattttctgtccctgaaccccagtttatccatgagtctatccccaatatctcctaccaaacctcatcagcatgagtcattgcccatttgtatatctctaagtttcttggtctactctggctgctacagacagcctccttaacattttgttgaccagtcttccagaagctggtcaaatcaacctcttctttcttgtagaatactgttagcctttggtacggtcctttagatttacagaatcagttgtctgtcctaaaataatctactcctgactttatttctctttagagcaggacctcttatcctccccttttccactctgagccatgtatagagaactgcttgtatccttgaccctgtgtgtttctcttgcttccacctgagctctaattaggaaaacttattctgaataaatgacacttggaagaacaaactctgacttacaaagtagcattatacagttttaagtatttttagctaccagctgtgcaagcaataagtaagagactttgaagtgctaaaaatatttgggaagtgtcaagtgggagttggcaaataccctggggtgagaaaagccctagatatgatacatctggcacacatttttagaatgttctatttttagtctgtgttttgatttctgaagagatccaggggtgtttcccttaaaaagaagcaaaagtgacagaaatgcctttagagaacaaggtaatttctgaagtattctttctctcttccctctgcccttcaaattaaaattggcatgatgcctggcattattcttaaatcataaatcactctgaaatctttagaagaaaagtgttctgtaatgtgcaattatgaataagaaaacactgcttgtaacagttaagtatcttgctttttggttacagctctgaggttatcactgccattatttttttcctagttattattattgactaatcattacaaaatcttctagctaattctttttagttggctcatatatgacacttattttggacagtatattcaattgagcccttgtcattgtggctcaataaataaagaatataaccaaaggaaaaataaaatttagtgatgcaagtttgtcttttggttcaagttctaatattaccaatcctcagaatatttcctgatttctagtctcaggaaatacagtaacttgaatacagtatggagctcctagataagctctctttatcatatacagatctcttgctggaagatctcctgtggccatcaatagaaatttaactcccaagcctcctaattagtattaaaaacggggagagagactggggatgggtgtgagtgtgctcatgtattgaattggggtaagaggcaacagagagtccagtcaaaaaatcttagtgaatcttacttttctactatatccctaaggttctgaaaaaaaaaaaattagctcatgggttaagaaatgcctgaaacttacacacttaccagtacaatttgttaattaatagagttttgagttaaaaggtaagtattgattatcagcaagtctttatacagttatcacctctgatttccaataatgccatggattattaaaccttttatttcttgtcagccccatgtcacgtcttgtacagtttgtataaagacacttgatatcccagacttcctcaaggaatctgtcactttctctgtatgttcttaaaattttcagtctcctctagtgatagtattggtttgctgtaaacatttcctgattctgtctgacaagagactgttagtctttgaacaacaacaacaaaaatctctgaaaaataatctgagaaatcctattgcaatactatcattagtgtaatggtgatttaaaaatacgtttaaggtattacaattttgtgatgtcttttcacagagatttagtttataaaaaatccaactcatttgtaaatatcataaactatttgttaatatatttatgtctttacaaccatttcaagtttttaacgactaagcattttttctcgaactttcaaaaaaaatgtatcttaaaaatttagattgtttttaaagaaaggtggttccaaaatgtatgttttggttctattcagtgtaattgtggagtgtccacatagtcttaaatttatatattaaattattttttagataatttgttgagatcattaaacaaatgtttagttttcagaatgcactaggaggtgaattataggtatgggcacctataatattacctatatgctttttagtttctattttgatattgtgttacaaatgtctcaggttttaaatctcctttaaaaactcagcagaaagagaaatttatttgattatgtgttgggatatagttgcaaaaattaaagataatagcaatgttgaaatttggccagtgatctgcattaactgaggagaaatgaaaagtgtttctgtggcatcacaaacagccagctaaacctccaacaatttaaaaggcaacctacttcatcatctttaaagcagagggaaggttggcaagaaatatgcatcagcaatattttctagttgaacaaatatctgaatataattctaggcttatgtttccaaaaaatgtcccagaccatatttaaaaactgcttcaaattatgtctcttaaattatgtttatgattcatatattgaactttcattaccattaaagagacttattggatgtgtatgcatgagtgaattaagacatcgtgttttgtggtagttgataagaaagagaaggagagttaatggcctagaatgctgacgtttcatgggttcttcaagacagcgttcaccagggaaaggaaaacttttgatggcattcatcaaatttgtcagagaaattaagaattataaaatcttcctcttaccaacatgcagaatcatgcaggcgttcctttattttatagatacacctatgataatactgcaagtactaaaataataaagagagctatcaaatgattttttcccctgcaaggaaatgtccttcctgtaatcagtagctattatagcccagccatcgttagccattatattagccttctctttttggtcagtagcttaagaattgaaccataacatttataattcagtagtttctgcacacctgtctactttgtcactggctcaggggattttgatgtgcatgttttgcctcagtgagtcagtttcattgacgttcttgcaaaagttgcatacacagtataaactttcctgagaaagatacttctttgccataaggcttaaaactattcataaaataattctaattttaatctaagtgatctaaatttaagaacaaataccaaagaatcaaatccatagttaattcatgcatgatagataagtaaataattggtatttatatttgaagcaagctcagtgtttcaatgcaaaggttttatgcatctgtctgtaaaattgggattgctgttattgttctctgaattcatgaaggtcagtttaactaaaatgcaaaagttgcttatagcattatttacataaggatacaggtggaatgcaaaggaaggctgcatctgccatcatggaaataagttttatgaatctttaaatactacattagttgtctatgtatatttattttcctcattaagaaaaactgataagggataatggacatatctccttagtgtaatctggcataaacatcttaacggctctgacttcagttttatatttacttgtgttatcatctgattatctgtcttctccctttgattgtatgctccataaaatgagtccagtcagatcttgcttatcattgtattctctgaatctatcaccttgcctggaatctagtaaatgatcaataaatgtctgttgaattaacgagcaaattataagaaaagtgattcaatgttttttttaaaaaacttcaaaacacttgttcacacttgatcaattgaaacttgttaataaaaatacaaaattagactgtgtaatttaatgctagtactattggtgtttcccagaagcaaaagtgtatataggagaggaaaaatgtgttttctgtctgcccttctaagttcttggcagaggcctctgtaaaaaaaaaaagacatattaacaagagaaaagcatataaatgcatctaatgtaggttaatatgacacaggagtcttcataaggaaatgaagaaatgattaaacttgagtgcttttatgctaggcttgatgaagagtggaaagtcacagacaaaatgggtatgagctaagagtattaagctgagggaaacttggcaaggtctgtgcattcagatccctctcagcatccctctgccattgtacataagaatactcatttcctagttcatagcattaaatgactacatcaaaaagtctgaaagagtacagcttagacaacctaatgtcacaccttaaggaaccagagaaacagaacaaactaaatccaaacccagcataagaaaagaaatcacaaagatcagagcaaaaataaatgaaattgaaacaaaaaaaatacaaaagataaatgaaacaaaaagctgattctttgaaaagataaacaaaattcattgaccattagtgagattaaccaagaaaagaagacagatgatccaaatgagctcaattaaaaatgaaactggagattttaaaaccaacaccatagaaattccaaagatcattcaaggctactgtgaacacctttatgcacacaaactaaaaaatctagaggagatgggtaaattcctgaaaatatacaggctcctagattaaatcaggaagaactagagacactaagcagaccaataacaagcagcgagattgaatcagtaataataataaaaaatgcccacaaaaagtccagaactagatggattcacagatgaattctatcagacattcaagaagaattctttgaattcttcttttcaaattctcaaagaagaattggtaacattcctactgaaatgattccaaaagataaacgattccaaaagataaagagggaatcctccctaaatttttatatgaatctagtatcaccctaataccaaaaccatgaaagcacataacaacaacaaaaattacagaccaatatccctgatggacatagatgcaaaaattcccaacaaaatattagctaaccaaatccaacagaatatcaaaaatataatacaccatgatcaagtgggttttataccagggatgcagggatggcttaatatatacatgacaataaatgtgatatgtcacataaagagaattaaaaacaaaaaccacatgattatctcaatagatgcagaaaaagcatttgataaaatttaatatccctttataataaaaaacctcaaccaaatagacatagtagaaacttatctcaaagtaataaaagacatatatgacaaaccaacatcatattgaatcaggaaaagttgaaagcatttcccctgagaactggaacaagacaaggatgcacactttaaccacttctattgaacctagtactggaagtcataggcagcgcaatcaaacaagagaaagaaacaaagggcatccaaatttgaaaagaggaaatgaaactgtcgctaatcaccaatgatatgattgtatacctagaaaactctaaagtttcgttcaaaaagctcctatatctgataaattcagtaaagtctcaagatacaaaatcaacgtacgtgaatcagtagcactgctttacaccaacagtgaccaagctgagtatcaaatcatgaactcaatccattttgcaacagctgcaaaaaacaaacaaggagttgaaagatctttacgatgaaaactacaaaccactgctgaaagaaatcatagatgacacaaacaaacaaaaacacatcccattctcatggatgagtagaatcaatattgtgaaaatgaccatactgccaaaatcaacctacaaataaaatgcaattcccatcaaaataccatcatcattcttcacagaactggaaaaacaatcgtaaaatttgtattaaaccaaaaaaaaaaaaaaagcccacatagccaaagcaatactaaggagaaagaacaaatttggaggcatcacattacccaacttcaaactatactacatggctatagttaccaaaacgacatggtactggtataaaaatagacatgtagaccaataggacagaatagagaacccaaaaataaagccaaatagagccaactgatcttcaacaaagcatacaaaaacataaattggggaaaggataatctattcaataaatggggctggaaaactgacaagccacatgtagataaatataaatggttcctcatctctcactttttacaaaaatcagctcaatatggatcaaagacctgaagtcaaaaattctagaagataatttcagagaaactcttctacacatggacttaggcaaaggattcattcctaagactccaaaagcaaatgcaacaaaaacaaaaatgaataaatggtacttaataaaatgaaaaactttctgcacagcaaaagaaataatcagcagggtaaacagacaacccacagaatgggagaaaacattcacaaactgtgagtccaacaaaggaataatatccagaatctacaaggaactcaaatcggcaagaaaaaaataatcccatcaaacagaaggcaaatgatatgaatagacaattctcaagaaaggataaacaaccaacaaacataagaaaaaacatgctaaacattaccaattattagggaggtgcaaattaaaaccacaatgagataccaccttactcctgcaaaagtggtaacaattaaaaagtaaaaaaccgatagatgttggtgtcgatgtgttgaaaagtgaacacctttacattcctggtgggaatgtaaactatgaaaaacactgtgacaattccttaaagactaaacgtagaactaccattcaatccagcgatcccactactgggtatctacccagaggaaaatatattgttatacaaaaagacacatgcacatgcatgtttatagcagcacaattcataattgcaaagacatggaaccaagctaagtacccatcaaacagagtgggtaaagaaaaggttatatatatagatatatgtgtgtgtgtgtatatatatatacacacacacatacacacatacacataccatggaatactattcagccataaaaaggaacaaaagaatgtcttttgcagcaacttggatggattggaggccattattctaggtggagtaattcagaaatggaaaaccaaatatcatatgttctcacttataagtgagagctaagctatgaggatgtgaaggcataagaatgatacaatgtatatagctcaggtgacaggtgcaccagaatctcagaaatcaccactaaagaacttactcatgtaaccaaaaactacctctactcaaaaaactattgaagtaaaagtaattaaaaaaaaaaaaaaaaagaatacaccttttctggccagccatagtggctcacagctgcaatcttagcactttgggaggctgaggtgagaggatcacttgagggtaggaatttgagaccagcatgggcaacatggtgagacctcactctatttattttttattaatttttttttaataaaaagaatgctccttactttcaagtgtagggtgggcaccttccacattagggtcagaaagtctttcctgcacatgctgtttctcaaattccttcagctaaaaatactcaatgtccaagatgccatattttgagtagtctctctaaaatcctatcaaggagaaaattaaatatatgtatttattctaattcctcatttgcttagtaggtgccataagttttcaggaaaattactaaaaaaatttttttatcctatttggaagtctgttcaactactaatgacagttacaggactgaacctccttagaatctcttcttttctctgcttcttttcttgtttccttttctttcttttttcttttctcttcctttccttcttttctctttccttctcttcattctttcatctttctgttttccgatttttctttttctctctttctccctcccttcctccatttctttttttcttcctcctgcccaccctccctcttccctctctttcttccttcctttcctttccccttctctctccttccttccttcatctttcttcctttttttttttaaaaaaaataacatatgcctgtggtcctagaatactattgctgaaatgtccttggaaagcactttaagaataaaaaagttaaaagcaatgatgttcccagcattacactatcattttaatgtcagaataaaaacttggaaatagctagtgattcctaatttaaagatatctttattatgtagggaagtttatgtagaggaactttccctctgaggtttcaataacagagtcaccctgccaaattaaactgacaatagacagatgatcaaagcaaaaggcatagcaatttattaagatgcatataaacatgggagtcctgcaaatctaagacttgaagggccagatagctgaagcttaaataacctcttcatagcgaagagggaaatgggggatgtaggcaattgagaggggtagtaaatgacctttaggagaaatcaatgggcccaggagacagaaattagcttgtaaatgattctctttggaatatgagtgacactgaaagagacaatgtcttgtgacaaagtgtgtctaggtgttggttacattcttcaatcttccttcttgtgttagataatgaaatttcagggagggaatagaaggaaattgcgttccttcaggaagagcttcagataagggaacttcataaatagagttctaccttatgcttggtgggaagaaacaggagaaggtcaaaaagtccttggtgctgaggctgtttctaaggtcttttaatttccttgagttcaaaagtgctcagcatgccgaagcaccatactgtggagcgttgctctcttgagcttcaacaattacatttaagctagactgaaaaatatagccacaaagtattaataaataaaatagatataatgagaacaatgtatttaaagacatggatataaagatatattggataattctagcaaaatagcagattaggctgttggaaataggcctgctttctgccccaaacacataaatgctttgaaaaaactatgagaatagcaaaaaaaaaaaaaaaaaagtattattgctctccacataactgaatttgacagaaagaaagatttcccaggggtgaaaaacaaataatgaaaaagaaaatgacaggggaaggccaaatctctgatagtccgctggcattctggcattagataccggcaacaggactgtaggctgcagtccctaatgcccatttatagataaagaaatacttcatctcaaacaatggactagaatttaggcctctacatcaaataaagagcctaagcttattctttgctctgaataggaaaaatctatccatcgacctgcaaaatattagggaagctatttaatctagggatttgagtcagtgtgagggagaatcactgacaagcatcaaaaccccagcttccctataaatgaatgaaagttttgaagttatgttaaccatagaacacagtaatctacaggatgagaaatgatataaaaatagagtcggggtaactgatgctatttgagctctaggcaaaagcaagtttcataaataaataatctaatttcttgtaagatatccaaaagaaaaaaaatgaattagaagcaaaagtcaatgacatagtggcaaacaatgttttcagaaaagaaaaatcaatatgtgtgcacctttcatattgaagggtcacagtgagtcccaaataggatagtccaaagccctacccaagtttaactgcagcatgttaaaacaaagaaaaaactttacatctttgagagagagagattgagagaggtatgtagacaaaaagaattgaactgtgtaaaatattggaagagatttattctgagccaaatatgggtgaccgtgggctgtgacagccctcaggaggtcctgggaacatgtgcccaaggtggtaggggcgcagattggttttatacattttagagagcatgagacatcagtcaaatacacttaagaaatatattggtttggtccagaaaggtgggccaactcaaagcagggttggaagtggggagggggaggtttccaggctataggtgaatttaaacattttctggttgacaattggttgagtttgtctaaagatctaggattgatagaaagggaatgttcaggttaagataaaagattgtgcagaccaaagttcttttgaagtcttataatggctgcccttagagaaaatagatgacaagtgtttcctattcagatcttagttaatctctttaggattgggagggtctggaagaaaaagatctagctatgttaatagagcttcttttatagatgcatgttcttccccacaaagaacaactttgcggggctatttcaaaatacggcaaataaacatgttttggggtaaaatatttttattttcttccttgtctggtaatgttataccagagtcaggttggaaaatcatgatatatagggttaaataaaagccatctgatgagaatgtatgatttgtagggcatgactccccagtctctttagataggaatttgggcaagattaaaaaatcagtttagtcctcaggtatatactggctttctaaaaaatgaatgatggttagagcaaaagtggaagtctcatcagcaaaacaggaggaaaagtagaaagtactgagataaaataaccaactcagaacaatacccagcaaattaacaagaataaaactgaagtgaatatatagcaagcccaagaaaggaaaaaacaagacttaagaatctatcattcaaaaatcctcactgacagaaaaaccaccggaattatttcagaaagaagttaattaaaccttaaggaacaagtttgtttctagaaaaaaatagacaaaaattttgattaacctaaggaattcttgtcactaagttcaatattactgttaaatatactgactagttttgagtgtctaaaacaagaggaattaaatagtagacaatagtaaagtagaaagatagaatgaggaagattgaaaataaaagtgttctattttctgttgtctaagaaatgtacagttgttccttggtatccattggggattgttttcaggaacccccctgggataccaaaatttatagatgttcaaattctgtatatcaaatgcactgtatttgcatatgacctgtgtgcatcctcctttacattttaaatcaactctagattacatataatacccaatcaaatataaatattatataaatagttattgtgctctatggctttttacactgtatttttgttgttgtaatgttaatatttatttttaatatttttaatctgtgtttggttgaatccacagacagaatccacaaatatggagggccaactgtatgaaaatattgtttttatttttagtttagtttgttaaatcaagcttacttgtcaaaagaggaataaagaaaccaattaaaaagtaataataaataaaagccaccaaccattgtgttggaaatgaatctatcatgtcattccaatgaattacaatgaatataaacaaattctcccattaaaagccacagtcgtgcactagattagaaataataaatccacaaatacactatttaaaacatgatgcagaaaagataaaaataaaaagattgaaaaagatataataggaaaacgataatccaaataaagttgttaaagctgtagtgatctaataaaaaaaaaaagcttgaaagcaaaagacattgctaaagtgggtcagtatgaaataatagacagcacatttcatcaggaacatacaccactcctgaatgtattttgcattataatcccaaaatacatgataaagatgtacaagaattataagtttagattgataagtctacagtcagaggggaagatactattgtacttctttcagaaactatcttatcaaacagacaaaagtaataatatggaaaattaaaaacacaattaaaaaatcttaaattaattcatgtatttgaaagaactctttattctttttaagtgttctcacaaattaattatgtacttattcataaataccaaaggatgaactaaatatactcagatctaaatgtaataaaattagaaaaaaattatgaggagagcaatcagatacattcaaacactgagaaacatacttccaagtaatccaagaatcaaataaaaaagtataatggcaattattaaatgtttaaatcttcaaaataataaaaccaaaacttaaggaagacaagctaattttatggaaaaaaattatatggtcttaaatgagatttttataaaggagtaagaataaaaattagataagtattcaactaaagaaattcaaaaggccaaagttaaccttaataaataatacatacataagctaaaagcagaaattaatagaaacaaatgattaaaaatagaatggccaggtgtggtggctcacgcctataaccctaacagtttgaggacgaggcaggaggattgcttgagtccaggagcttgagatcagcctggacaacatagcaagacagtgtctctacaaaacttaaaagattagctgggcatggtggtgtgcacttgtggtcccagctactctggagggtaaggtgagaggattgcttgagctagggaggtagagctgcagtgagccatgatcatgcaactgcatgccagcctgggcaacaaagtgggaccctatttaaaataataataataataataataataataataataataatagaatgtatctcaagacaatgagaagaaaacctacatactgggagaaaatatttacaaaagacaatctgataaagaactgttatctaaaataatgtgatgaagtcttaaaattcaacaataagaaaataacctgattaaaaattgggtttaaaaaaatgaacagacatctcaccaaataagatattcagagggcaaataagcatatgaaaagatgcttaacatcatgttattagggaattgcaaattaaaataactaacagctatttaatattattatagcaaaaatgtaaattactgacaacataaaaagtggccaaaaatgtggagcaatagaatctctcattctttgctagtgggactccaaaatggtacaatgactttaggaaacaatttggcagtttcttataaaactaagtgtgctcttaccatacagtctatcagttggactccttggtatttacccagaggagatgaaaacatatgtctgcacaaaatcctgcacacagatatttatagcagctttattcataattgctaaaacttggaagtaaccaagatgtccttcgttgagtggataaataaactgtaatgcatttagataagggaatattattcagtgctaaaagaaaatgaactatcaagcaataaaaagacgtggtggaaatttaactgtatattactaaataaaagaagccaatttgaaaagacaacatgttgtataattccaactatatgaccttctggaaaaggaaaaattatggagacagtaaaaaagatcagtggttgttagggattaggaggagaaagagatgaacagacagagcacagatgatttttaagacagtggatctattttgtataatatataatggtaggtacatgtcattatacattcgtcaaaatccacaaaatatacaataccaggaatgaaccctaatataaattgtggactttagaagataatgttgtgtggatgaaggttgttcttggtcctttggctagagaggaccaagatctttgatgtggctttttgtggttgtgcccattgacatttctgggttgtcaacttaaatttaagtatatataaggcaaaaggaaatccaaggtaacttatcctcatgtcattccttgggccctgaagtcccttagagtttccttatgtttattttatagacaatatctaaggtttttagttgtgcctagatgaaggaagctcttccgttttctctgaaacagaaattcagtttcccactttgccaagaaaattaaaataatcctaagaaaatctacaaactcccatgaaatatgtatctactcatagttatctgtattaatatagtcttatctcatatcctagactctctatggtcttgtataaaaaaatccccaaattcatcaagattttgaaaggatctatgtgcttctacctcctcattagactacattcatctttttcattgtgccatcgcaggcaacattctgtcatacaattggtgcttagtaaattgtgacaaaaattaacaaatagtgctattatagttttcataatatgtataagaacatttaagtttccttttaattttatgagttgactttatatgtataaatgaggagagtgaatgaaatagagattgaagtagagtggaatagagtgaagggagattatgttttggtataaaagatatttgagtgagtgtgtgtgtgtgtgtgtgtgtgtgtgtgttttgcattgaattatcgtaaggtctttgttctgttcactgatatatcttttaagcttgaaaaaaaaaagcctggcatattctaggtgcttgattgatcatcttgaatgaatgcatgaataaacagtgatgtattacacttaaaaaaaaccaatggtatttaggttagaccacgtgttaccatcaaatgaaaatataaagtcttttctagtcttgggaccttatatattatgtgtgttggttcttcttggcatttatttcttaaacatttccattctcctttaagtgattttatcactgcctcttttatattcaccactgagtatcttatggcactgaatatagcagacctcatttataggagcaatattaacctgtattgatttgcagtcatgtaacatttaaatgcaaaaaggtttattaatggcattctttcccaaagaacagaaaaacagttgcatgcttaaatgtatgggtgtgacttgtcatgcatgctgatgtattctaccattgttatgcttgccagctgcaaaccacaatcagaaaacccctagtaattataatagaacaaattaaaaagaggaaaatcttctttctctctgcttagctttcgtgaatacgggaagtcaaaaataaaaatcaggacttagtaaatttttgttgttacagaaaaggtatttctctattttatgtattaataattgaagttggaaacagtttccactggagcttgttacacagcagcagccctttcacccatctccaggccttgaaagtagtggtatgtaaactacaggagtatgattaccagcataggtattgggggaaatgcaccacaatatcctttccatatgatagattctatttggacttttctgttagcaagcacttgcttacattgtagtatttttctttgtaatttccaattatgtaaaatctcaagccatacagcagtaaattaaatttgtaataaaaagttttgagtttaacttcctctgacctggagtcttcacttttgtagagaagcaaaagtatagcctttgttttcttgcttagtttagtttattgagataatacaaagtaaaactcatcctttatagagtacatttcaatgagttctgataaatataaacaatgtgactaccactacaatgaagatatgcaacattctcattaccccaaagagttgccttgtggctctgtgttttcaatctcctccccaaagttagcccctggaaaacacagatctgatttctgcacctataactttgaattttctagaatgttatataaatgggagccacattttcttttaaaagaaaatttaaagggctgtgtacctttctgtatttgtcttccgtcacttagcatatgcttttcatattcattcatttcatcgtatgtatcagttcctttttataactgaatagtattgcaatgcgtggctgtataaaaatttatccatttacagtttgttagacatttaggttattttcagtttgtgatcattatgcataaaagtgctataaatatttacaaataaatttgtgtgtagaaatatattttcctttatgttgaataaaaatccaggagatatttatgggattttggtgagtaaatgtttaacattgtactggtatctcagagtgttttccaaagtggctatatcatgttgcactcccaccagtagtctgtgagagtttaggttattccatatcgttgttaggacttggaattgccattaaaaaattaatttttgccattgtaaaaagtatgtaaaggtatcacagtgcaatttttgtttgcattttctaatgactaatgatactgaatataatttatttgtttcacttttgtatttttgtttataaagtgttcaaatattttgcttatttttattgtattttaaaattttataattattgagttgcaaggttaatatttgcattctggatgcaagttttatcatacacacatacatatgtagccatgggttctgcatctggagatttaaccaactgcagatggaaaatattcagaaaaaaacactaaaaaataataatacaacaataaaacagataaaaatacaaaaatattataacaactatttacatagtatttacatagtattaggtaataaaagtaaccagagtcatttaaaatatacaaaaggatgtgtattagttatatgcaaatataggttgagcatccctaattttaattcaaaaactggaaatctgaaatactccaaaatccaaaactttttgagtgctgacagactcaagtagaaaattctataattagtacttaacacaaaatttgtttcatgcacgaaagtattaaatatattgtataaaattacctttgggctatgtgtgtaatgtatatataaaacataaaagatggggttgtttttttcttgtaaatttgtttaagttccttgtgggttctggatattagccctttgttagatggatagattgcaaaaattttctcccattctgtaggttacatgttcactctgatgatagtttcttttcctttgtggaagctctttagtttaattagatcccatttctcaattttgacttctgttgccattgctttggtgttttagtcatgaagtctttgcacatgtctatgtcctgaatggtattgcctaggtttccttctagggtttttatggctttaggtattacgtttaagtctttaatccatcttgagttaatttttgtataaggtgtaaggaaggggtccagtttcagttttctgtagatggctagccagttttcccaacaccattttttaaataagggatcctttccctattgcttgtttttgtcaggtttgtcaaagatcagttagttgtagatgtgtggcgttatttctcaggactctgttctttttccattggtctatatatctgttttggtaccagtaccatgctgttttgtttactgtagccttgcagtatactttgaagtcaggtagcatgattcctccagctttgttctttttgctgaggattgccttggctatatgggctctgttttggttccatatgaaatttaaagtagttttttctaattctgtgaagaaagtcaatggtagcttgatggggttagcattaaatctataaattactttgggccatatggccattttcatgatattgattcttcctatacatcagcatggaatatttttccatttgtttgtgtcctctcatttccttgagcagtggtttgtagttctccttgaagagatccttcacatcccttgtaagttgtattcctaggttattttattctctttgtagcaattgtgaatgggagttcactcatgatttggctctccgtttgtctattattggtgtataggaatgcttgtgatttttgcacattgattttgtatcctgagactttgctgaagttgcttatccacttaaggagattttgggctgagatgacagggttttctaaatatgcaatcatgacatctgcaaacagagactatttgacttcctctcttcctatgtgaatacactttatttctttctcttgccttatttccctggctagaacttccaatgctatgttgaataggagtggtgaaagagagcatccttgtcctgtgccggttttcaaagggaatgtccacttttgcccattcagtatcatattggctgtgggtttgtcataaatagctcttattattttgagatacattccatcgatacctagtttattgagagtttttttttttagcatgaaagggtgttgaattttatcgaaggccttttctgcatctatttagataattatgtggtttttgtcattggttctgtttatgtgatgcattacatttattgatttgtgtatgttgaaccagccttgcatcccagggatgaagccgacttgattgtggtggataagctttttgatgtgctgatggattctgtttgccagtattttattgaggtttattgcgtcgatgttcatcagggatattgggctgaaattttcttttttttttttttttgttttatctctgctaggttttggtatcaggatgatgctggcctcataaaatgagttaggaaggagtccctctttttctattctttggaatagtttcagaaggaatggtaccatttcctctttgtatctctggtagaattaggctgtgaatccatctgttcctgtgctttttttgattggtaggctattaattactgcctcaatttcagaacttgttattggtctcttcagggatttgattcttcctggtttagtcttgggatggtgtcaaaaagtgggcaagagatatgaacggacacttctcaaaagaagacatttatgtggccaataaacatacgaaaaaaaagctcatcatcacttgtcattagagaaatgcaaatcaaaaccataatgagataccatctcacgccagttagaagggtggtaattaaaaagtcaggaagcaacagatgctggagaggatatagagaattaggaatgcttttacactttttttgggagtgtaaattagttaaaccattgtggaagacagtgtggcaattcctcaaggatctagaaccagaaataccatttgacccagcaatcccattactgggtatatacccaaaacattataaatcattctactataaagacacatgcacacatttgtttattgcagcactgttcacaatagcaaagacttggaaccaacccaaatgctcatcagtgatagaccggatagagaaaatgtggcatatatacaacatggaatacccagcagccattaaaaaggatgaattcatgtcttttgcagggacatggatgaagctggaaaccatggttctcagcagactaacacaggaacagaaaatgaaacactgcatgttctcactcataagtgggagttgaacaatgagaacacgtggacacagggaggggaacatcaaacaccagggcctgtcaggtggtggggggctaggggaagggaggggtagcattaggagacatacctaatgtagatgacaggttgatgggtgcagcaaaccaccatggcacgtgtatacctacctaacaaacctgcatgttctgtatatgtatcacagaacttaaagtatatataaaaaagaaaaaaaaacttaaaagaattttgtgtttagacttgggttccatccccaataaatctcactatgtatatgaaaatattcaaaaatccaaaagaaatctaaaatcccaaacaattctggtcccaagcatttcagataaggagtacccaatctacactgtgccatttcacataagcaacttaagcatctgtggattttggtatccacaggggtcatgcaaccaattctcaaggatactgaggaacaattgtatatgttttcacacattttatctctttgtaaattgtgttgtaattttcttaataatatctgtagtgtgctacaagtgatatttcatggttataaaattagtgatagacaaaatatctaattaagtgtcttgcaaggacaatactacctgctacttaatggtagatggtaaaagggcccaggagactttccagatctccttgataaccggagatggggacttcccagagaccccaccaggatgggattttaagaccctcatagcaaacatgcctgggtattactgggtctctatgataatgagtcctaaaaaaccctagttgttctagagacaaggtcgcctcagcacagaaacaaccttcgtgtactagccacccatccatttttttttttttttttttttttttgagatgagggtctctcttgtcaaggctggagtgcagcggtatgatcatgggccatcgcagcctcaacctccaaggctatgaactttaaaacaaagcttacccttccaagaatagcttaaagtccctttatgaaagaaatacctggtaactgacctagatttaatgccagtataagaagaggagaagaatcccccaaactctgagaatagcctccaaacagagatcctccctgactgaccccctgcctgtacctggcccatgccaccagcctgctcctgctgtccatctgataagagccctgcctaaatagacctcttgagcattagctggtgtctaagactcatctttcatgtgtaatggatggaagaagagaagtcaccccagggaagctggtcaactaggacaactggggaccaccgaagtgacattatctttacaaaaaggagaggtggtttttgttgttgttgctatttctaatgttgatggagtcctatttaccaatttatattttaggtttgtgctttttgagtcctgtttaggaaatatttttctagtccgcgatcacagaagttttatcttaacttctctagagtttcagatttagattttacattttgatctctgaccattttattttttaaaattaattttgtatgtgattacttttgtatactatgtgaagtatgagttgagaaagcgttggtgtgttttttttttaaattaacgtcatacatattttgattttttttggattgttctattctgttctgttaatctttacaactacttttccactaataccagagataaggtaatatgatcatggcgtgtaagtcatccaatcttgttctttttcaaaattgttttggtgattctagtccaaggtttctcaacccttgggacaattgaccatttgcgcttgataattatttgctatgggagggctgcctgggacactttagaatgtttagcagcatccctggcctctactcactggatgctaatagcatctttcccaattgtgatcaccaaaaatgtctccagacaatgccaaaaatcccctgggagacaaagctgtcctctgattgagaaccattattccagttctttgctatttcatttacattctagaattggcttgaaaatgtggcaaagaactgacataactttagtaacttttctaatccttgtatgtggcatatcttccatttacttaggtttttaatttcctttagcagggttttatagtttttatcatatagaaattgcagctctattgaccaatttatctaaaaataccttatatatttgatactattataaatggtgctttaaaatttactttctgattgttgtttgtaatacagtcatgtgctgcgtaaagatgttttcatcaaccacatatatgaaaatggtcctttaaggttataatatggtatttttactgttccttatgtttagatacataaatatttaccattatgctacaattgcctgcagtattcagtacagtaacatgctgtacaggtttgtagcctaggagcggtaggctatatcatgtaaagtatagtaggttatatcatctagatttgtgtcagtacacactatcatgttcacacaatggcaagtttgcctaacaatgcgtttctcagaatgtatacctgttattaagcaatgcatgacttatatagacatgcaatttatttttgtatgttaaccatatatcctgcaaccttgctaaactctcctgttagacctggtaaatctctgatagataccttaggattttctacttggacaatcatgtcataagtgaataaagatattttttctccaatgaaaagatttacgttgttatctgcagcagtagaaatatttccatgttgtttgtttaatttttatctatttatctatctaaattgtttatcagtttaattgcactgtaattaatttaattagattgtctatttatgtaactaaactgtctctgccattaagtagttttcagtaaggcatttcaaaaaatagatgattcaataagaaagctaactagagtctgttttaagttagaggtttagcatattttctaattatttactatctcattcttgcattgagagataacagtcacataaattttgaattcatgaaaacagattatttatttccttccagtggctgatatagactgtacctctgtagaacatataagacttaatgcccattttcttctatttttaagcctctgtgctattttgtaagtctttgtatacaaacagaagttcagtcaaagaagtaagaggatcatattatatacgtatagaaaatatgttttttttttctctttatgcctttgcaggttttaagaaattgctacccatatttgaattcttacatttggtataaggatcaaattagattatgtatataaaatcctattttaagctgtaaaatgagaggcaaatgctagctagatatggcttacgcatgcagtaaatactccatatatagtttttgaattgctagtccttttcagatatacagaaaatttccattgaaccttaaaagcctcaagaagaaagagaagtgagctaattttttttttttggctcagcttttactctagttactggtacataacgtacctctgaaaatattactaagcaattaggacagagttgttttatgagattgacagtgttcttttaaatgccacctatccagtgcacatagttgaatttttctactttgcaggaatttgtgcaatttctccaaataagaaatatttggaggactctagcatggcagaaaacctcagtgggtctgaattgtctaggaccatacatcggaaggatgatgcttcttttctatgttagtgcttagtctctgctattccacatttaatgctttctctgtctccttaaaaacatttccaaataaaaaattaaagaaaatctgataggtatgcacttgcagacattgcttcaacattttgtattaatatagaaccattggtcagtaattatgctgaatatgatttagaatagaaactgaatttgaatcttacctgttacctgtacatttcttcttcaaaggaaaatatattttgtgtacatacacacacatgcgcgtgcgcacgcgcacgcacatatataatgtctattatttctgtaattgattctgcaatgatagcaataatatattttatttgataatatctccaaaaaacgttgaaagttttaagatgtacttactttctgttgcaaaaattacttttacattcaagaagttcaacatctttattacaaaaggtttctgggaaaaatatagatttctataaactatatatacatggacacaggagattggtttatggagatgagcaaaatgaccatcagacactcaccaattgcactgaactcaaactttaaaacaaaacaaaacccattaatatgcaaatgtaggcaactcctgcattctttaacatatttctgaataacttctaaaaggataagtttttcttcaataaatgatgaaacttcaagtttaaaatatataaacactaaaaaaattgatttcatatccaagggtgaatttctctttatttatatctgtatccagctggtagtgggtggtatctcattcctggaaattcatgtattggaaaggaaatgcttaagagaatattcatttagctacaaagcaatggcatttcaagctctgaaatgtcatttggaggagtccctgattccatgggggagaaatgtggctgttctttggcagacttggtaaagctcacttctcagattgatgggtctcgtaaagtcctattggctttgttgactgagctgtacatatcagtatgatttgactgggcttgtgccatattcacattgtgagaattattgtcattagtatcattaatatgcatgcattctccttgttgttctttggatctgtctgaaatttttagagaaatagaatactggcgaggcctcaaactgatgactgtgtgcatttttattttaaaaataaaagcaatttattaataaccatgcatgggaccaaggtggataactaggaaaaccatgttacaattatgtggttcataacaaaatcatttttatgtgcaaatttgatttgtgttattttttgtcttatctgttaaaatatcttttatgttttagtactttgatatagctgattatagtgatgtagtcaggcttttataaatctaatattaatgcaggttacagaaggggaaagaccttccttttattgattgatttttaacagcttttgttcttaatgatcaaaataaaagagttcatgccagaaaacttggaaagtactagagcaagaaactccaaacaaaagacaccgtaatctataattcccatagatgcctttgatattttgatctgtttgtctttcccagcttagggaacactgtggcaaaaaagttgggtttctaaagaataaaaacactcacactcttcctcgatttttgttgggctgagtccacctcacacattgaatggatacatggaagagtggcaactacagtaagaatactgatcacatggtacctgattgatttgcaagtgttacttctgggtacaggcagtgggaggaatcctgttaacctattatataaaaagactagcattggtataggaattcgaagtgtttcctaccgctgtagaccaactcttacctggtgtcaggattgagttatttgtctggtccactagactcagagcttctcctaattttttatttcctttatgtttgttcttctcttgaaacttatggagacctaaaggccctatgtgattcgattccagtattccactccaaatttatgtactttcattctccagtttgctcaatcagatacagtgatacattccttctttctgatttgctctgaaacatgtcaaactcattccttgttcagagatcttaggctgtattaacataatctggaatgtccatttccctgctctaatgtcactttctcagatagacctcccttcactactctctctaaataaccctccagttaacacctatctttttgtttgaccccatttaaaaaatagaacacattatttaaaattgctttgaggtttttatttatgtatttattgtctgtcttgattttctgtcacgttcccccaacctccgagcactgtgatattagaattgaggttgtttattttgtacatctttgtatcttcattgtttagataattttagcacagaggcaatgcctaataagtaaatactgaatgaatgttggataatagagcttggttatctgtttgcatgaatgtgattattagataagttccagatcatagaatcttaagattcttctttatactcactcaagacaaagaggacctagtctcccaaaacaaaaaggttgtctaccttccccatagaaaataaggaggattttcattccttcataatataaatatatgtttaatactacacataatttttattgattgcattctattatatggatataaaatatttttaatcactaacattttactgttgatcattttattttcttccagttgttctgtattatgaatgtcacctctgtggatatttttgtccacatatttgtgtaaaactctgattatttccatagactacatttgttgaaatgaaattgctatattaaaatgtatgcccctctttcagtattttccatactaccatttgaaagtttgactgattaaatacttatggtttaaacactcataaggaaaaatagatattttcagaaaagtttgaaattcttggatacaattttttgagttttcagttttttttaatttaactgcattgttaaagtgaataaagattgacttttttttccaaagtgagaatcagagaaaactaatttgtctgtctcactctatagccattttagccaaaataggaatgtgaattgtttcaaattgtcattctttcttacttctgtttactgttactcttaaaataattgagggtaaccgaaaaataaggcttgaaacacatcagcaagagattgtattcatattgctcattgttttaatgaatagaatcctttaagctaactttgagggatgtgtatctcttttcttaaaagttaaatgttacgttttatctcacaaagatgtcaattagcatgctataagagaaactctttctaaaacatgccccccccccaccacgggtggcatgagcagatatttaatgcacctgctgccttgcaaaaatatcaatcacattgtactccaaaaatgtccaagtaaaaaaggggcaacatttaaaatgtgtggttttggggtcacctgttaaggtatctttagtttcctttcctagaaaaatgattttcttcactgataatatttcagctttgcttttaagaaaagttaatgggtgaaaggatggagtttaaattcttaacagtgggtaattcacttattttcactatttggttttacaatttgaaaaatgagcatattttagaagacacttccccaagataagaattacgtgagtctgacaggaattattaagtatagcgagggaagattggagaacaaagtcattttgaatacatcttagaaaaggagatttttgggcagttgcggctcacggttataatcctagctcttagggtggctgaggcgggaggatctcttgagctcaggagtttaaaccagcatgggcaatatcgtgagcccttgtctctatttaaaaaaaaaaaaaaggaaaaaaaagtttttttctttttaaaataactatgtggtaaatactttttgaatgagtttacataactacctgatgcaatatattttccatgaggagcctcatatttctgagtcctcaatagaaaaaatgagtttttaaaggatattccatataaacaagtatgttgctttttactataaagagtagctaaaatttctccttaagaaaagtattattttatctacatgagaggctttaatgtctttttggagctgaatattatccagaagccctcaaatttatagaacaaatgtgaagaatattaagaattctatctagctggaaaagcaagcctttgtcttaggaacctggtgtgtatatttcaatctcatattcttaacttttctgtaatccaaatcccaactggttatgatttatattctagattttaaattttttccttttcatcattttacattctacccaaatctttagtaaaaagcctatttttggatattaaactattaacacttataattgaattcagactcatctagttaaaatactagggaaacagtccaggacattggtctaggccaagattttgtggctaagacctgggaaacacagacagcataaacaaaaatagacaaatgagactatattaaactaaaaggccttctgcacagcacaggaaacaatcaacagagtgaaaagacaacctgctgaatgggagaaaatattcgcaaactactcatccaactagggactaatatccagaatatacgagaaactcaaaggcaaaaaaaaattaatttaaaagtaggcaaaggatctgaatagacatttctgaaaagaagatatacacatggcaaacaggtagattaaaagatgagcaacatcatacatcatcaggaaaatgcaaataaaccacaacaagctatcatcttactccagtaagaatggctattatcaaaaagacaaaaaataacaaatgctggtgaggatgtggagaagagagaactcctattccctgttggtgagaatgcaaattagtacagtcatcttggaaaacagtatggaggtttctcaaaaaactaaaaatggaactaccatatgatccagcaatcccagcattaggtatttatccaaaggaaagaaaaccagtgtatcaaagggatgcatgcacccttatgtttattgcaccactattaacaattgccaagatatggaatcaatctaagtgtcctaagtgtcttttacatcaaccaaattatgtcattgttaattgcacacatacataaataaaagaaaatttcaaaaacatggtttatgtcattggctttgctattagcaccttgcttatcactaaaattaataacatagcaataataatgtttatggcactctattaccatatttcaaaattttagttttatatttaaaaataaataaaattataatatcttaagtgttagagaaatgtctgccatctaaacttttaattttctaagctaaagtagtctgaaagcagaaaaaattaccctcaactggactacttctaactgggatagttttttaatatgatggaccaaggaacacagaaaaaatattaaatgtagtatatttcttctggaattaattatgaacatgttaatataaaatgttatctcatactgtgaaaatcatattggtaagactccatgccattctgtatttctctaaaattctgtacaaatgctagcaactctattttacttttgttgcatacacttttcttgtggcatgaagcttcaatttcagacagagcaaactgtgccttgacttattcatgctgcattaattagagcaacttattttcttccttatagatgaatactgcctaaaaataggagttctgacaatctgtctcttattgatgaaaaaattttttgatacactttgaattgcaactgaatgaaagctcaatgattagactttgaacatgtcactctaccattcttcattttgtgactcagcattaatattttctgtttatgaaaggaagcccatttaaagtagaaacttctggcccctttggcgctttatgttccccacatcttagagtttatccagaacacattttgtggtataataagagaacatactcacagcttgtgtttattgagatgtcttaaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaagtgcataatcctgaatgacaaacaactatgaagtagtaaatacgggtgattaagaggaaaaatttttgcaagcaaaaagtcctaagtttaaatcacctcaattaagtaaaattcttttaatatatgtgttatcttaagtgggaattgtcaaattctattatatatctaattcataagtcagttccagagaaaagatagaagctttcataatttttttgcattgactaaaccatgcagtagcccacatctttccagcatgttttgaaggaattctttattaatattatcatataataactagaattatatgtgtgtacagatattataatactttcctaaacaatatagtgttatgtataattttgttgcatatacttcttaagtaatattaatgtatgtgcaataaaaccagctttttggtgaggtgtggaaagagcagatgtaataatggacaaaatgattgtaacattaatctataactattgcaactaatcataactgtacatctgaaccacaagagtagcctgggcctcacttcttgaaattggtttggtacgtttgaactgatgccaagtatgacctgtagttttaaaagaactcctgaaaattctcagtgctcttcctccagttaatatttattgatatagaagagtgacggctcagcctttatgtattagataattgcactctaacatatgtgttattgttgtaacctatttgtagaataaataagagaagatgagttatttattttccttgctgtccttctaaactcatactaaggtgctagtcttttcctgtctgtatgtgaagttgagggtagtctccatgacttttagagtcatttacaaataataaaaggcatctagacacacacatacatacacacacacacaaacacacacaatacatatacagagagagattaaaaaaacattctcagttcaattattaatatttcaagacacgtgtaatgttgcaagtaagtctgggcctccctttgctccaccataggtgtactgattccattgcagcttgttgcacttcacaggagcctgacacttacaggatctagaattctggacttttttttttttttcaagtgtaatacaccagtccactgtgacccccaaactctgggaaacaccaggcttttaaatggtcactttggagtccctttaattttacttacatatgccttacagagttaaatagaaacctttcagtttttgatagtataaaaggaaagatgaaggagatgatgcacattgctatgaagaactatctaagactgggtaatttatggagaaaagaggtttaattgactcacagttccacaggctgtacagctgtcatggctgggggacctcaggagactttcattgcagaaaggtgaagggaagcaagaacatcttcacatgctggcaggagtgagagagcaaagggggaagtgctacacacttgtaaacaaccagatctggtgagaactcactcactattacgagggggaaatccacccccatgatccaatcatgtcctaccaggtccttcccccaacactgggaattacacttcgatgtgagatttgggtggggacacagagccaaaccacaccaatggacaagggacagaccacttcatgttaatgtctcaggttgatgaaataagcagaaatttaagaaaatgatttaaattgcaaaggtaaccaatagtattactaatagaacaatagtaaaacaccgtggggaggcagtctagagcagctgatgaataacaaacgaatacattcttatctttcagggtaggaagtcatgaatgatgactagaattgaaaaagcaaaaaaaaaaaaaaaaaaaaatcatgtgtaaagatgagattataattaggaactttaacacgagaaaatttactgtttttcaaccatcctcatccaaaattgttcctggagccagagaagggtgtgaaagagtactgtaggcctttgctaccagtaacttcattagagttaatggaaatatttagtctacagccataccaccccaaatacaccttcatctgatcttggaagctgagcagggtctttggcttggttggtaatttaactggacactgcctgggaatacaggacacttttttataaaaggaaacatttaaaaaataagagtgtgactatattctaacctttcaaaaaaaattcatcaagagagtcttctagatattcttaaaatttaataacaaaaattaagtcaaagttaaccgaatttttcaagaactaaaatggtgttagaaatttgtcatgttaatgatatttaataaggcaatattaagttgttagggaccttatgttgaaatttactaatactattgtccttttttaagcgataacttttgtcaaagtggcaaggaggtttcggatgggcagaaattagtgcacatgttgtaccttccctgatacggaaaaccctgattcatcatctttttctgattgtatcatttttgctcttgtcactaatttgtattcttttttccttcctatgaatgctttccaaatagcattctcaacactttgctctcttactatcctgatggatccatccacgttcctaggcttaaacattttaatttgttgtgttttcatgtctttctttgcctacaagattgtgttgagactgatatggtgagtgccttgaacactgcctgaaactgattgtctagaatgaataaaatgagctagacaatgaatgaatgaataaatcaatgcagttatggaagaataaggtgcatacattgctttcaaattgtaaggagacttttcagataggaaatgtcacaccaaaatatttaattacagcattaagactggactgatgagaactaaactgcctccttatcaagagttataaaaagaagtactgtgctacctcaggtagttcacaatatactgtgtacatccttaatccatattacataggttagatttatttttgaatatatataatttttcttggacacgtatcttttctacatatatgtttattgttaaatgcatattttatatgtttacaattacagtcttacatacactgtttatattaactctttatcagatcaagtaattactttctctctgtcaactgaaaattgggtttttattaaagcagctaatgtttctctaatttcctttatccaggttagaaagtgtctatctcttggttttacagatcaaataacctataacctcatcaaaataaagcatatttgctactaattacatttagtatatagtgatattaaattaattttccatgaagactctattactgaggcttcatttagttaataataataaagattctgggagtcttagtcactctcttgttgttatagcagtgcatagcttttaaaagtgaatgacttgatgttcaattgcgttttataaaacatcaaggtgcatttactttgccttgtataagaaattgatgagtatgtgagatgaggttaatgcaatgggtaaaatacatcaattccatgttacaactaatagccttaatagtttagcaaaccatataaaagtttgcctttaaatggacacttaggctaatttgacagcatgcttgccattaggcaacaattcctgtcattagagtgatgacatttttttcttccatccccactcaattctagaaaaacaagagagaggaagaaaggaggacaaactgtttacttctaacattaagttgtggtgcctgtgagtcaaactaattatgcttttgtagctgaaacaaccaataaattttcacagctggtactttgcacctgaaacactttgcatttattagctaaaattatttgctatatacatgattgcttagagaggggagatttttttctaaagctgtattttatatcacactggtagtcattttcttccaatttttgaaacaagatataaaccttctatataaattgcataaatattaggggtttaaaaattgtttcgcttagtattgtaatataacatataatagaattatttccaaaaatgagaatcttgactggcaaatacgtctgaatacagttataaaacctgaagaggtaacactcaactggtctcttcctcctttgctccttttctctttcccttcatttcccttttctccttcccttcatttcccttttctccttcctttccttcctttccttccttttttacttctccatccacctttcttccccaaagcagtaattgtgcaaagtctatgctgttttcaatgacagtagacatttaagtgacattattgtataataattgtattttattttattttgttttaagttctgggatacatgtgcaggatgtgcaggcttgttacataggtaaacatgtgccatggtggtttgctgcacccatcaacccatcacctaggtattaaagccccacatgcattagctatttattctgatgccccccccccacccccacaaccctctacactgttgtattataattttgtctatgcctctggatcaaatgacactgaaaaataaaaactttatattccaaacattttataataagtaaaccagatattctaagatttccttttgtaattttgcaggtctaatattaatttttcttttgcaaaatcaaagcagattttactgatataaattaaatattttatttcttacctatgtcgttaagaaaattgtacagaatatacagggttgggaaactgtagcccatggaagaaatcttgcccactgcctgtttctgtaaataaagttctattggaacacagctggaaaccatcattctcagcaaactatcgcaaggacaaaaaaaccaaacaccgcatgttctcactcttaggtgggaattgaacaatgagaacacaaggacacaggaaggggaacatcatacaccggggactgttgtggggtggggggaggggggagggatagcattaggaggtatacctaacgctaaatgacaagttaatgggtgcagcacaccaacatggcacatgtatacatatgtaacaaacctgcatgttgtgcacatgtaccctaaaacttaaagtataataataataaaatttaaaaaaagaacaaaaaaaaataaataaaataaagaataaaaaaataaaaaaaaaacagccttgcctattatttctttacttattgctaggctgctttcacacttcaagcaatggcagaattgagtagttgcaacagctagcagatggtcttaaaagcctaacctatttactctatagctctttcagcaaagatttgccaaatgctgcactagagtgttcacttagcttgatattttgaccgtttggtcaatgactgaagtttcatatagcattggtttgaaggtcattgctgcatactatataagtcagcatatggacatttattccttcattcagccatatcaaatgtttcttttgccaggcaataagaagacaaaactcaataagacaatttttgacaataaagaaatgtataaatatatattatcatgtacaaaactctgagatatattctgtcattcttctacagtttgtatatatattctgtcactcttctacagtttgtaaggagtactgtggaagtcatacttgttccattcacccttccaattctccaaaataattatctgcagaataaagcagtagcctttaacttctgaaattacagttctgcaaaatgttaagatatggagataaatttcatagctaatgggacacataattgtaacctaagataaaaattgtattctttttagtggcataatttttctgatttgtgcctgccttatccacctatattctactcacacatgaagatacataatttttacaatattacccttttattattatttaaacagaaaatgcattgcaccagaatttccttctagcagaatgtgcattcactctgtgaggacattctcagtgttctttgggggaaatagatactctagggacctggagtggaagagattaagtaggactccatttactgtttcatttggtttatcttttaccgcttttccagtttaccagagttgtagatctagagctgcaggtttttctaaaggagatcaaatttgacatagtgatatattgagaaataaaaacaagataaggaaacagtatttccttatcccagttcctccagaagtatttagttgtaaagtctttattgagaagccattacatgtccagcactttgctaagagatgacattgagctcaaagcttcactaaaaatggaatttgaattgtgtattttttctccatctttcaatgacttgtacaccacaagtgtgctccaatctacttatactgtctcatttctcaccagcttaaaatgtctactcttttaaactgtttccagtttctccaggcagtttttattgttctaacctgtcttaaagtagcctgttatttatctcttggtagtaatacccaatttattttattataaatcatgtatttatatgtcagactgtcttcctaaatggccagctttccaaggttaggaagctgtattttattcagtctttttccctgccaggttccaacataatgtgtcctaggtgtacctagcatagcctatgtacttaatgaagattagtgtaggattgtgatagaaaaaaagtcccctgttaattatcagtttttcataaacacacatttaatcacaaaatacaacattctattgaaaaatggaagaaagtgttgatataagaggtactttcagattgaaatttttatcatctttgaaactgtcctttaaaaaaatatagttaggagtgataatctctacactatttgaagattactgagtctgacaaaaaaaaaaccagaactccaagggttccataattcttctcactaatagtatacctgcctttaagtcaaaaatagaagatgtgtttggaaaaagaaggaaaggagaaatacaggagtacatatagcgttatgagtgacagacttgcagattgaatttctacaaacttctttgttaacaaggccttagtatgggattctgccctctgatactattcttatttcatgatttctaagaggtaaatatccatattttccaaagacagtgaatgacacatagatatcctgcagtaagagattgctaatgcaagttattgactgaatattgaagtaactattggtattttaatgttcttctctttaagaaaattctgccactctctactcccactcaagggttttttttttttgcatgatgccaagttttacatattcattaaaataatgtgcaatctttttttttacatattgtaatccattatgtaccttaagtgatataaagctattgtctctggggagaaaacttgtatccctgtgaataagtttagtttattatagaaaacacaaagctgcttacttcagagcttgtaagatatagaataataggtaccaaaagccacaagaagaatgttcagggaaaacaggccaatcctggtatgttttctgtaaatctctctctctctttttaaatctgaagtgtgatgtgttttgatcaaagatgaacatgtatcaataaaacctggaaacatacttaactgtgctttttaattttctagctagcaatgttctcttctagaacacttcgaagtataatctttttttttttaaggctgttgactcaaagttacaagacatagatatgccattagcaagagattgaaaagtgaattatttttgtacacacttttatgctacagtgacctatgcttttgatcttgggagaaaaggtgtattttattgagtatttatgagaccatgataaagctcagtgttaaacttaatagtcagtggtttctttttgtgtctagcattttgcttattagaggaaaagaaacaggaatataatgtgtatagctgtttatgtattaaatgatcttgttgaacaagaattcgtaagatgccatcatcccattgacacaactttttttaaattccttatggctctttttcctgttcttatgagaaaatagtgagatgttcattacttttctggactaccatagaaagtacaaagccctgagtttatttgaagtctcacacttagtacaattctgaagtttcagtgtctaatttctgacaataatccaaagtcatatgataaaggttgcatagtcattcctcctataggggatatatagggattcccgaagtggcagaagtcaccttctccctgactgccaactgcagatagtgaagaaaagtgttcaagacagtttcttagtgaaactctctgggcctcatgaaaatatgaaaaatagtaaacacaaatatgtaaatacatatatatgaaaatatatcagatataaatataaaatctttagagatatttaaaatactcaagttggacaacatgttgactacagttgacaatatattgtattattgaaagatgttaagaaagtggatgtaaagcattcttacaacataaatgataattatgtgaggtaaagcatgtatcagttagatttagtcattccactaatgtacatatactttaaaacatcatgtggtacatgataaatatatataattttatctggcccttagaaaaataattttaaaaaatcaatattgatagtttatctcatgttatagtctgtttgaaatctgaagttaaatcatatttactatgaacaaaaggtttaaaaattaaaattcaagctgattctttaaattttaaaattatttttaatttttatgggtatgtagtaggtgtacatatttatagggtacatgagatattttcatacaggcatacagtatgtaataatcacaggagggtaaattgggtatccatcacctcaaatatttaccatttctttgttataaacattccacttatactttattacaaaatgtataataaattattgttgacggcagtcaccctgttgtgtaagcaagtactggatctttttctttctttctaacaatatttctgtacccattaaccatttccaccccctgacttttcccagcttcttgtaaccatcactctactctctacctccagcagttctattgttttaatttttagctccccaaaataagtgagaatatgtgaaatttgtctttccatgcctggcttatttcacttaaaataatgtcttccagttctatccatttcgttgcagatgacagaatggcatttttttatagctgaatagtactccattgggcatatgtaccacatttttcttatccattcagtctgtggatggacacttagattgcctgtaaactttggctgttgtgaatagtgctgcaataaacatgggagggcagatgtctcttcaatatactgatttcctgtcttttgggtatattcctagctgtgggattgctagaccatatgaccattctatttttagtcttttgaggaaccttcattccattcttcatagtgatgttactaagttacattttcaccaacagtgtactagggttccctttttcgcacatcctcaccaatatttgatattgcttgtcttttaggaaaaaaaaagtgattttaacaaggatgagaaagtatctcattgttgttttgatttgcatatctctcatgatccttgacactgagatatacctgtttgccatttgtatgtctgcttttgagaaatctatattcagatcattgcccattcttaatcagattatgaaattttttctcattgagttgtttgaactccttatatattctggttattaagcctttgttggatgggtagtttgcaagttattctcccaatctgtgggttgtctcttcattttgttgattgtttcctttgctctgcagaagctttttaatttgatgtgattgcacttgtccatttttgctttggttgcatacaaagttgagtaatacccccaaagtgcatgcaaccaaatccagtgtcctgcagaattttgcccaatgtttccttttagtagtttaatagtttgggatctcagatttaggtttttaacccattttgatttgatttttgtatatggtgagagataggggttcattcttctgcatatgcatatccagttttcccagtgccatttattgaagagactgtcctttctccagtgtatgttcttggtacctttgttgaaaatgagttcactgtggatgtataggtttatttttgggttctctattctgttccattggtctgtagcataatttgaagtcaagtattagttctgtagtatattttgaagtcaggtaatgtaattcttccgtttttgttcttattgctcagaatggctttggatattctgttttttatggtcctataacaattttaggattattttttctatttctgtgaagaatgtccattggtattttgatagggattgaattgaatttgtagatttctttggttagtattgatatttttaacaatattgtttcttcccatttataaagatggaatatttttccattttttgtgtcctcttcaatttcttgcatcaatgttttaaattttcaatgtagagatttttttggttaattcccagatacttgattttatttgtacttattgtcaatgagattatttttacatttctttttcagactgttcgtcgctggcatatggaaatgctactggtttttgtatgttgattttgtatcctgcaactctactgaatttattagttttaatttttttggtgaactctttcagtttttccaaatatatgattatgtcatctgcaaacaggcatacataatttgaattcttcctttccagtatggatgctcttgatttctttctcttgtctgattgctctagctagggcttccagtactatattaaataacagggataaaaatgggcatctgtttcaggtttcatatattagaggaaaagctttcaggtttttcccattcactatgatactaccagtgggtctgtggtacatggctttctttgtgtgtggtatgttctttctatatgcaggctttgatggtttttatcatgaagagatgttaaagtttatcaaatggtttttcagcatcaattgaaatgatcatatggtttttgtacttcattctgttgatacgatgtatcacattgattgatttgtgtatgttgaaccattcttacattactgcgatagatctcacttggtcctgatgaaggacctttttaatgtgttattgaatttggtttgctagtattttgtagaggatttttgcatcactgttgatcagggatattggcccataaattcttttttttttgatgagtctctgtctctgcctcgttttggtatcagggtaatactggccttgtagaatgagtttggaagtattccttcatcctctatttttttttttgaatagtttgggtagcattggtattagttcttttttaaatgtttgataaaattttacaatgaagccatcagatcctgagtttttctttgatggtagactttttagtatagcctctattttactacttgttattggtctgctcaagttttgaatttcttcatggttcattcttagtaggttgtaatgtcaaggaatttatccatttcttctagcttactcaatttattagcatagagtagctcatggtagtctctaatgagcctttgaatttttgcaatatccatagtaatgtctctattttatctctgattttcttcgtttgggtctcctctcctttttattagtcttgctggagttttggcaattgtgtttttcttttcaataaactaactttttattctgttgttttcttttttcatttcaatttcatttatttctgatttgatctttattttcttttccttctactaactttggatttggtttgctcctggtcttctagttctttaagatgcatcattaggttgtgtatttaaagttttttcttttttttaatgtttgcccttattactgcaaactttcctcctaatgctgctttctctgtactccatagattttgtgtgttgtgttttgattttcgtttgtttcaagacattttaaaactttctttttaatttcttcgttgactcagttgtcattcaggaacatattgtttaattttcatgtgtttgtgtaattttcaaagtttctcttgtcattgatttctagttttattccattgtggccagagaagacacttgatataatcttaatatttttaaatgttaaagcctttttttgttgcttaaagtatggcatatctttgagaatgattcttgtgctgaagagactaatgtggattctgtagccattgagttaagtgttctgtaaattaggtctatttttatatagtgaacattcagtctgagttttctttgttgattttctgcctggaaaatctatccaatgctgaaagtgaggtgttggtcttcgtctattattgtactggggtttacctctctctttagcgctaataatatttgctttgtatatctgagtgctccagttttgggtgaatatacatttgcaattgttatatccccttgctgaattgacacctttgttatttctttatctcttcttacagtttttgtcttgaaatctatttttttctaatatgtctactactgctctctttttggtttccattgccatgtaatatctttttccctccctttattttcagtctatgtgtgtctttctaggtgaagtgtgtttcttctaggcaacagaccatttgctcttgtttttttttaatttagtcatctactctgtgtcatttaattggaaaacttagtctatttatattcaatattaagtaaagacttactactgccattttgttgtctgttttctggttgttttgtgattcattctctcccttcctccctctctccctccctgcctccctccctccctccctccttccttccttctttccttctttccttcctttcttccttcccatctttctttttgtgaaggttattttctatggtggtatttttaatttcttgatatatatgtttgtgtatccattgtgggttttaaatttgaagttaccatgagacttgcaagtaacatcttatattccattattttatactattgacaacactgattgcaaaaacaaacaaaagaccaaacatgcaagagaaagctagtaaaactttacactttaatttcatcctctgcttttaaacatttattggttctatttatattatgtgtatgtcttgaaaagttattgtagttattatttttgatcagttcattttttagtctttctactcaatatatgagtaatttatacaccacaaatacagtgttgtacaaaacacccatgtttttctttgtatttaatatcatcagtaagttttgtaacttcagatgatttctttttgctcagtaagtcccttttccttctgattgaagtactctctttagcatttcttgtaggacatgtctgtgatgatgaaatccctcagctcttgtttttctgggaaagtctttatttctctttcatgtttgaaggacaattcactggatatactatagataaaggtttttttcccctttggcactttaaacatgttatgctactctctcctggcctgtaagacttccacagaaaagcctgctgacagatgtattggagctcctttttatgttatttgctttttcctttctttcttttttctttttctttcttttttttttttgctgtttttagaattctttctttattcttgaactttgagagtttgattattaagtatcttgagatagtcttctttagttgtatctgcttcgtgttctataaccttcttgtacttttcaatattgatatgtttctctatgtttggaaagttctctgttaatatccttttgaatgaaagctttctatcccaaactctctctctacatcctctttaaggccaataactcttaaatttgcccttttgagggtattttatagattttgtaggtgtgcttcattcttttcttttttttttcttctttttcctcttactctgtattttaaataccctgtctttcagctcactaattttttcgtctgcttgatcacttgtgttgttgagaaactcctatgcattctttagtatataagttggatttttcagctgcagaatttctgcttgattcttttttttttattattatactttaagttttagggtacatgtgcacaatgtgcaggttagttacatgtgtatacatgcttgattcttttaggttattttaatctctttattacaattatctggtagcatttgaattccttctctgcattatgttgaattttgttgagcttcttcagaaaagctattttgaattctctgtctgaaaggtcacatatctctgtcagtcatggtttggtcactggtgccttatttagtttgatttttgagttcatgtgttcctggatggtcttgatacttgtggattgttggtgtttgggcattgaggagttagatattcatcgtagtcttcacagtcttggctggtttgtatctgtccttcttaggaaggttttccaaatactcaaagggaattaattgttgtgatctaagtctttgttcactgcagccatatctgcaataggaggcactccaagaccagtcatgttgtgactcttgcagactcttagagttaaccatctttgttttcttggataagatcaggaagaattctctggatttccaggcagagacttttgtttctttcccttactttccttcaaacagagtctctctcttcatgctgaactccatgaagctggggagggggtgacacaagcatcgccatggccatcaccattgggactgtgctaggtcatacctgaagacagttcagcactgggtttcacctaaagcccacagtgaccactgccttgctactgctgatgttcattcaaggcccaagtgctgtacaatttacagctgcttattccagccagcctattgtccttcccttcagaccagtgagcttctcccaagcccaagcaggtctgtaaatgccatctggaatccaaggcctggaatgtggaaacttaggaatctacttggcgctctgttctgcaactgagctgacacccaaactctaagacaaagtccttgtcactcttccctcttctttcctcaaataggagtctcttctcatagccaccacagtaggaatgtgctgtgtcacacctgaagccagcatggtgctgggtcttacccaaggttcacagcgcatactgcctgcctaccactgacgtttattcaaggcccaggggctcttggtcagaagatgataaatcctgccaggagtgagtacttcccttcaaggcagtgtgctccattctggcccatggtgtgtccagaaatgtctgggagctaggctccaaaatgggggcttaggactctacctgatgctctattctactgtggttgagctattatctaagttccaagacaaagtcttcttgctctcccctctcctctcctcaggtggaaggaaggaatctctctccgagctgtgagctacactgcctggggttgaggaaagagtaacacagcactcccttgactgcctagctggtctctcactgggttgcatgtactccaagtccactggctctgaatccagcatagcaccaggactgcagtcctagtggcctagactaccttcaggtttatttagaatgccagagaactttagcccacagtggtgggactagccaaaatttagattctgactgctagggtggatgattcccctctggctaggctggtctaaatgcttcctccatggacgccacctgaattctgccctctattgctttccttgtgatagggttgcactgaactctaatgcaaagtcccaagatcactgtgctctcctcccgcaagcatatacagattatctctctgggccaagaggctcctgctgggggatcagggagtggtggtgtagataatgcaacactgtctttcataccctctttagtgcctctttccttgatatgatgttaaaactaggtactctgctcacctcatttttgattcttataaaggagctttcttatgtggatagttattcagtttgttttttattctcgggaggatgatcactggagggttctatttgactgtcttgctctgccttctttcaagctgattctttctctcatgtctgctatctgtgacttgggggctcctttgtgaggcctctagctgcaactcccataccaggctgggtgttttccctggctgcccatccataccagccagcggtcttctatactctattgaatgcaggctctggctgtaaagtcgcctagcatctttaatgatattctcttggtcaacactttaatagtctgaggttgagtttctttcttgtagagttcatctttggaccacaagagacccacaggcatccttagttataatatctttcactgtatttgttttctcaggctgccataacaaactaccataaactgaatggcttaactaacagaaatttattttctcaatgcttcttgaaactagaaatccatgattagggcattggaagttttacttttaatggggcctctctctttggcatgcagatggctgccttcttactgtgccctcacatagttgtccccaggtctgtattgactgtgtcctaatctttcctttttataaggacaccagtcagattagattagagcccacccatgagaccttattttaccttagttacacccctctaaaggctctatgttcaaatacaattcttattctgaggtactgaggattaagacttcaatttatgaatttaggggaacagtattcaacctatatcacccacattatgacagaatgtattcccagaaacagcacaacccaccttggctcctctgccagagtgactcaccttcatcactcttactacctagatgtcatgggaaggaatctgactccagatcaccaagtcctccaaactcccaagagagacagctgaaatgcttccagtgatacccataaagtccttcttactaagctttaggtggaagaaataatgttctgtcttgctatgggagaggaaatgggactagcagttctcattccaaaaatcctccttataaaattctctcaccccactctcatattctaagcctgtgattttcaaccttagggatgccattgggattgagcaccaatgctcagaccctcagaagtacaactgtggtctggatcaaaagccttacattcctggaagcttgctagcaatgaagactctcaggtccagcatgagacctattgaatcaggttctacatttaacaagatcctcaagtgatatgtgtgcccattaaaatttgagaagtttgctgttatagactagtggttcctaaattttagtggacatcataatcatctggacagctttttaaaacacagaatgttaggccctatcttcagagttttcaattcagtacatctaggatggaccctgataatttgcacttctagtcaaatttcatggtgatgctgatgctactagtttgggaatcactctttgaaaccaccatgtgtagatactacactgtccaatactgcagccactatgcacatgttatagttatttgaaatgtgctttgcattgagatgtgctataagtaaaaaatatgcatcagatttcaaaaagacagtatgacaaggcagcatatcacatttatgattttttattgattatatgctgaaaggctagtatcttaatattgttgagttaaataaaacatattaaaattagttttactttttaatttttataatctgaatactagaaaatataaaattatatatatggttcacattatatttctgttgattggcaccgttcatcttgatctccatttggctcaggggtccctgaagtgtgtctaaagctgattcttgatcatttaccttgaaaatttattatttgctcttgtatcttactttaatatgctatatctgacaaatcttggcacctcagtgaaaattccagttttaacattccaggttacatgtataatattttggataatcttcatcaaatccataaataagacattattatctgcatttctccaaatgagaaacctaaatgaaaataacttacctaactttctctaactagcaagtaagatgcaaatatagatttgtctgccttccaagtccatgcttttccagttaaccatgcagccttcactctagcacagagatatgtggatgctcgatcttgtgaattttttgaaaactgtctgcttaagtatgtataactgcacctttgtaggagtttcatataaaagtaaatatatctagcagcagcttagtgtttaacaagacaatcatttcttcttaatggaggaatttaactagattgcaaatgttaccatctttaaggatggtgtaatcaagtaattgtgtttttgcatgtttttgtttctttgtttgttgtttacttagactcttgccaactcagactgttctcagacctggggcagcactggctatgttatattattattatatttataataattatttaatgtaagtatattcattctgtgtaactggatgctaactttgactctttcctctttgtttgtgccagacttctgaatagcccttttttctctgactttatgagtggtccagacacaagtaatagtgcagtgcaatagggagtatcaatgcaaaaattcttgaattctacattccaagttagctctccagagcaaattgactcaggccaaatacattttctctatgacactttctataacaaggtaggcagtatatttcctaagatattagattgtttctttttaaacttctaattaaatcacttagaaaaccatattgcagttgtccattgtatgtcaatatccctgattcaatggtaatcttgaggacacagattgtatattttttttaatctccagagacatgtaggcatgcaataaatggtctgccttggacttaccttacactaaaacccttgacactagaagtgggtgatttaaaaagaaacaaataaaaagtaaaaaataaataactcagagaaactctttaccttcattcatagttttcatttgactgttcaagaggaatatctaaggtcttatgatagtaaaattttcttattctttagaaagtctgactgtatctattttagaagccctatagtctatagtagtttttgataactatatgaattaatggatgaatgaatttccaaaaaattattgaaaactggatttttaaattaacatgagagaccagtaaacatttgtgtttgtttaaccaaaaaaaaaaaaaaattctattatctttgtcattttatgaaggacattctaaaaactaaagtatagaaaagatataatctcagaataaaaatcaaattttgaaaacataaatttatttttattttaaaattcaaggcactaccctatcacattccatggactctagttgttagttgtctgtggactattaggacagaaccgcttgtttgagatgcaaggtcagagtgtaaagggtgtgaagggcgatgggagagtctcatgattccctctcctttgtgcggcctctgttcactacacacagcaggagtgctttcgtagtcagctcacctatttgagctagttacccttttatctttggcttagtaaaactgccattatagaaagaggaaaaagccacaaacatttaagctgtaaaacgttagctcctcctttaatggaaagatgtgaaccaacatactttgtatatagggcaaggatcagagatactggaagattttaacaggcagagtaaccatagactttttgaaaggagaaaagtgttctataaccaccatgggtcacctgttgatcattcctcattagtaaagtcattatgtacttgccaagattaactgaatggaagcagaagtaaattcagatgtagataataccattacaggaggatatactttcttctaataggaaccaataaactctcatagtctttcaaaatgattcgtcacatgcctcaaatatttgcacaaaactggaaacataatttgcaactaattatttctctggatggatcctccatttataaaatgctagcaggagatctgcaaattctggcaaacataaaggctttgatggccatgaactacattaatataatattcaaagcaacaaagccaagacagaatgactaattatctaaatttcttctgcttttctctagttctatcccaataattgttttccaacatgatttacttcctctcatgcctcactgtatttattctcatacttccaacctcttcaaagcaagatggagctagtgatgactgatgatttgttacttttaacaattatgaaatttatttcctatcccacagcacaaaaaataccttgtctatttccctgcttttgctgtttagttttttatccagagaagcaaaactgaatatcctcccaaagtgcttcatgctcctgccaacacagaaaagttaatacagtttttaggtctaaaaattaaaaattaaaaacagtcttctctatctaacacactgggatctggtaaaaataaactgtaggaatcctagtgcactgagaaatgtcagcactctttcactttgccttctcttgtagtgggctttgttctctgttcctgacctcgtgcaatgctgtcctttgtttggcgtggcgcctagtttaccttttacttgatatagcttctctagcaatcacctttgattcaccagagatataaatctgcatttgtccttatcatggcctatttctagatctttgtgtatcttctttcctattcccaaacctagtcctggaccttgggacctcatcccaggcctcttccatcctacaaaagaagagtaagctcagagctgaacaaagttgaacaaagctaaactatttgccaaataaagttgttttgttttgttttgttttgttttaacagtacctcatttccaagtaaatcaatgtttgaagtaacagtgataatttgagataacttgagtcatttctttctttggagcctgttattcaaaattctctatcaaatagctctatgtaatatagtctgattttgttctgcctttcccataaggatggctacttacttgtccctcaactacttgattattacaattgcatgaaattttattccttactaagctctcttcatcaaacaaccaagcataccctcaccacaacatccacatgacctcagctatttctgagtgaatactgtagagcttgatttgtacagtatttatattattacaccattgtgaggaaaattgttaaaaccaagatttgtctcctgaactggactccaagtaccagaaagaaaataactatgtccctttgtctccagatgggttaaaaacccagcacatttctggatccttcctgataggaacataataaacattgaagtctggctttgtaaagaatcattagtctttctttgtaaagaatcattagtctctcttttcatatttacattttattatgagaacatatttctttttccccaggaacttaaagtactttaatttcttttgtaatttctttaagtataggcagggcaagataaaaacactttttttttaaacaacactagttaaataggcattcctttttccagtttttaatttttaggaatagataatgatacatatatgtgaggtacatttgatattttgatacaagcatacaatgtgtaacaaataagcctgggtaattgggatatccatcacccaaagcatttatcatttatttgggttgggaacattccaagtcttctcttctagctactttgaaagagataataaattattcttaacaatagttgtcttattgtgctactgaatgctggatcttattcgttgtaactgtatttttggacccattaaccaaaccttcttaatcccctcctcctcccttttcttcccagcctctggtaaccattgttctactctctacatccataaaatcatccctcctccttccttttcttctcagcctctaataaccattattctactctctacatccataaaataattttctttagctcccatttaagaatgagaacatgcgatatttgtccttgtatgcctggcttatgtcatttaacataatgtcctccagttccatccatgttcttattagtttattaaacaaaatttgtttgtagcctaatgagtaagaaaacactaaaacacattttaccaccaagaaaaataaaaacgaaaaggagctgtctatatcatgaaagtgtggattcacatacaaataaatgaagtatgtagtaaaaaaagtcactaagggaagatcagaattttattttctctattgaaaatgtggagacttggtttctgagcattatcatctgacttgtttgtcagcaagagagagatgtgctgctctattttgcatataatgacacttgatcagttgatatatcattgtgaaaaaggcaaagggcatcatgcattcactgacgtatatacagcatcaacaggtgttaataacaactattgcaaatgcttcatagaataacaaaaggagcatagatcagacaaggagtgtagatggtctgcaactgctcttttgagaaggattatgtctaacacaaagaattatttcattaccacttccagtactcttgaaaaacaacaacaaaagaatgtgaggtttagagactgattgattaaaccactctgaaaatgtgatttttaaaactgcagaagaggggaatgacataagatgaagaagagtatctctatagggagaaggaaggttaatatatgagtaagactaaaggaaacttggagaagtgagagaagaaccttttaaaacgaattcatgcaagaaggatttatataacttgctgtctatgtaaacatggctagccctcccattaaatcagtgggttccaaccttaaatgtatcttaaaatatccaggggaagatttgcaaaatactgatgcccagatcacaccctcagatattctgattcaattaaaatttcccagggttttatttattattattattattattatttgagacggagtctcactctgtcactatgctggagtgcagtggcatgatctcggctcactgcaacctctgcctcccgggttcaagggattctcctgcctcagcctcccaagtagctaggacttaattttttgtattttagtagagacggggtttcaccatgttggccaggatggtcttgatctcctgacctcgtgatctgcccaccttggcttcccaaagtgctgggattattaccagagttttaaattatctccagggttggcaaccatttcaatatgtaatttcaaaggagattttgttttgttcatattaggagagactagtcctcagtctttattcctataagataacaaaacactgagccacgttggcatctttgcatcatagtgcttgtccaacagagacacaaaacaactataccattcttctaaagctaatctcctatttctctcaaggaatagcctgaggtgtacttctggttgctctaaccaaaggcctcagaatgctcaggcttagagtttctacaaaagaatgataagtaatgcaactcctcttctccccagatgattttagaatataatcatcaccatagtcagatacctccattggccattttcccaatgatacctaatgacattcagagatagcttataattttgctcttttatgacaagaaaccaaagtagccctgtcatgtaccattataaaaaactactaattaatgacatggcatcatgtatattttcagtctgaagcccaaatgaatcactacgaaatctaaaattgaccttccctcattctttctcatattttcctctcccctaatcttccctctgaggaatgatagtgttatttatatcatctttctatctatttatctacacacctacctacctattatttatcccttctatctataatttttttcttatgaagacaacaaagttcataatagcaaatttggaaaattcagaaaaacaaaaagaatataaatcacctattgtggttctagccaatgataactaatattacttagttgtccatcttgttagtaatttaaaaatattaggatgatactatgtatataattttatatcatatacttttcatgtaacaaatatataaaaatatttttcaatgtaataaaagcttgatgcttataagactatctactgtagaaatatagtatacttcttgggcacatcatgggaagcattagatttaattttaattacataattattatgaattattttaggtctttgggtattttttaaaataagtggattgtatccttttccaaatttagttttagaaacacttgtacagatacacacacatactttctctctctctggatatacagataaatagatatccatcactgttaaactctttttgcagattatctcatttaatcctccaccaatcctttgagttaagcagttaagcattattatttttacagagtaaaaaataaaggttcagatcaaataaatttctaaagatcaggttcctctgacgttaatgttcaaaacattttcaccactctaccatattgtatcccagatattacagctaaggaaatttatcttgattttctccaacagtttcatataaatattttgaagcacagagtaaaggtgaagaattttctagtgagagtgagcactcctatccttaatatctatattttgccattaacacttttactgtatgagttttatcacatacctttgtttctactcatcttgatatccatccatttatctatattatttttatgtgtatcagtccttaatttttgagccctattataccactgcctaaactaagcaatggctatgataaatatattttggctgttttagttttgtttcttttttaacattttgttctttggtcataggtaggaatgatcaaacccaaataatattaaagatctagaaaatcacaaagttattttgcatcagtatcaccagtcattgatcttctaggaatagaaaaattaagaaatactatactgggtgaagtcaaaaatctgcttaaaaacactggggttgaaaatgtagtcattctactacttttaggtacagaggaaacaattttttgaagctatttaacactgatttgattttcctcatgattttagtcagatcccagaaggcagtgccactgctagtcctcatgatgcttttatgtatgtttgaaaaagtatccctgcctcaagatattgatttccctctgtcggaaaattgtcattatgaaggtacaagcctgcaatgtgaacatagcccgtcaggttgtggttcctgtgtagtacacaaccactgctgctgacttcagagatcctccgggaggttcctatagtggattcagtggatgatgtatatgccctgctgggcttgactctgtgacgctctggaggggatccttcccgtgagcctgctgcttaggtacctggctttgccccagcagctcctctggtgagcttctgagctgtgttcttcaaccagtttctcagaaaatccaggaatctaacctacaacatgagaatgaacaatggctcaaggggctactctctgcctgtggggtagccctcctctgctggagcagtcatagagcagtaatagagcagtaacactgccacttcagtaaagctgttttcttctaccctaccactaacttgtccttcagttctttcctgtgcaaagccaagaaaaaaacaaagtgggtcaatgaagctacatgccagagccttgtacctcaacatttcacattatgaggcttacatatgatatagctactaccatgaggtctttcattcaatggcctgaaacatagagctgaacacacagaatctcttgagataattttctaaaatgaggcaaaaaattacaatattggcatttctctttctctacgtttatttccctcctttgctgtactcttccacaattctcaggtatcataaagccttggctattcttttacttcttctatatcagctctttcttctttctgagtctggttgcagattaaacctgaggatgacagtgatgaggaaaagtttaatgtgagaattagccattgacggcttaaatggtgctaaagaatcttagaaaatcttcagtctctctctcttccaaaagtgtggtttaaggcagattatgttgctttaaagtcctattttgcataccaaaattaaatattaactctcctttttctctttacattgcttgtcaatttctcctacctttctttataccttggactaaagagaaagtcatgtgcttgtttaaatttccatgcaggtttaaataagctacccatctagattacattattatggttgcttaacaaatcactgtgccacaaatttagtggcatacaagaacacccagttattatctcatagttctatagaccaaaaatcagtgtgggttcaactgggttttctactcaggatgtcataagatatcatctgggctggccttaagcgggggctatggttaaaaaatctactttcaagctcattttagagaaaatgacttttaaatggctggtgtgattagattacactcagtgggataatctgccttttcattaactcaaagtcaactgattagtaactttaagtacatctacaaaatctttttgttacataaagtaatataatcaaggtgtgatatctcattatattcacagtcccagatattaggatacagaatcttggtggaccacttttagaattctgcctaaaataatttcttattttaaatcagaaagctaactcttgggatttctgtaactctttgtgtatagtaatcaaaatagtccttctcagagttcacagttacctgtgaggagattattctagtgataaaattgaatttatgcttttttaacttttattttaaaaataagaattttttatttgttgtatttaattatgagtgatattacaaagatcacatattttattaaaagaaaaaagcagcacaacataagaaaatggccaaactacttataaaatactagcttttaaatatttacttttttggtattctttatatatatgctttatccattatgaaatctggcatataattctaatgcatttaaaatatagaaaacatactgattttatttctttggaatattgttatatccattaggaagaaggtatgaaagaaataacactatattttgtgtaatttgtttattcattattccaaacatcacttggaccaccttcttctgagaatgttgaagtctagaaaatttaagccagattatgttgacgttttaccaaatccttgaggagcagaataatgttttgcaaagtgaggataagactacattgacatttgatgacaaaaaacttatgagaaataaaaaagtaaatttagaactagtgaaataaataccttgtttattcactacttggcttacataatttaatgaacagaaaaaaggtcaatgacccaaaaagaatagttcctatctgcactgaacaaatgctagaattatcctcttccaattactttctacaaagcttactatccaacgtcccaagcagtgctaacgaacaaagaaaccagaattaagcattcgtttatttaaaatatgtgaaaattcatgtacatgccaaaacatctatgtattgtatagacataactacaggatctcactagaggattttgagaaaagcaatgatattattggattaaggctctgctatatttatttaaaatatttatttgatttattcttattataaaactggtcagtgtgtattctgaacaataggaaaaaagatagaaaatttgaaagaaacaagtgattatacaggctctctcccaaaatattttactgtgactataatattagatgtgtttattctagactttctaagcaggtttttcagttttgatcatatatgtataggctgatgtattcacttaatattgtaacaagtatttttctatgttattacaatctcttcataaaatcagtttttccttattgattcttcatcttacatacattttataataaatattatctcacacttaattttctctgtgcttgagtgaatgtctttgtatctgagtgatttaattctttcatcatatgctaactcttcttcattaattttttttattcagctgcctcttgcctaatgctttcagttctagaaatcattgagatatgctatggcacaggttgtttatgtaaaattgagtgacaatgtttttataaaatagttttcccatttatttttgcaaaagctcttttgtactcattaaacatgcaaagatgatggatatgcatttatttatgtacctttgacagattgaaacatgcaagtgacagtgtttttcagctatttcatgacacaatcaatttgattccagaaaacaaatgccaaaaactgatgaattcttagcgaaaatttaggttagtgatttttaactttttcactgtagcctttggctacttaagtcactaattgcttcaacaaagataatactattatatatattcaggttatatccaactcaagtttacacttcagtagtctttcataaaagctatcctatctttaataccatcttttcggaataatgattctgtttagagattttccctactttgttggttcatcatagatttgatgctacagtttctcaacaacatacattaaattggagtttgccttcttttaatcacatttatttattttttatcttattcattaatctaattgggtcatgtatgagaagtttataaaaacaacttatcctcttcatcaatttcctctggattcattttgcatagagaggaaatcaaccataaaaattaattccagagtatataccagcttccggaattggagttgcatcaacacacacataagaaacatcagatggtctgggctagattgtttgattttgttgttatgtcattggctttgttttagttcctggaaaaaaatgaataagggatgactactcctttaagagcttcagattttcagaggtccttgcatatcgcctgcctatctattgccatggttctgttctccctgtgcacatcactgataagcaggagcagactggatgagagagggatagaggtgttgtaggaggaaggctctttgatttgcaagtagaaaaatagataggtcaaggatgagagtaagttggtagaaagttgaacctatatcagaaaaccaaaaacgtgtaagtagctatgaaacttaagtgataaacaatatatatgatattagcagagcatataatagatatacttactaattgacaagattttaattttatcaaattatatttcaaggacatatctaggaaacccttaggtgtagaaattccaacaaaaatgatgtatggtattatttcactatcataaaagtatgcatctgactcaagattggttttgtacaaatcaggcacattgtacatttcttcccctaggccatcctttccctaaatcccaagcattctcacctccagttggactgaaggtgtcaattcctggctagagtctggttttatgacttatgttatagaacataactcctcactctttaagggggagatgtgcttcgtgacctccttccaaagagtgctgtatggaaatgtgggaaagagtaacttcacagtagagaaacctgaaaaacaccacccgatcaaagtgagaaagttgagcattagtagtgataaattatgtctataatatatgcctttgttatgttgttatgagaatttttacctctgttgtcctcctccccaaactttataaccctagcttaatcatgagaaaaacatgagacaattctcagttgaatgacattctgcaaaatacctgaccaatactcaaagctgtgaaggtcattaaaaacaaggcaagtctgagaaattgtcagaccttagaggatctaagaagccatggcagctaaacatagtgtggcattgtagatgggatcctggaacaaaaacagaaattaaataaaatctaaggaaagctgcacgaagtatggacttcagtagataatttgtatatcaatattgattcattaatttcattgcaaatgtactctactaatataatattaaaaataggagataaaggaaaatttctctaactgtagattgtaggcattttaaaagacagtgccttgcacttcctttctctattttctgcatagaaatagtgaccctatgttatatatttctgcctaaaataacttgtaccatacaaagttaaatgtttaattctttcagaagaacgttgcattaatttctacccaactactccattgttcttctcttatgttcttgtttaccggctcttgattgcaattcttccttatattcagtgctgttggagtatccctctgacacatcttaatgaacagatttatggttgtctatctttctcaagaggttatcagcttttaactttgtctttaccatgtgtacttgaatcttgaatcattgtggttttggatgataactctgaatgcaagattctgaaataatacagtttaaaccaaacaatttaaattggcaagtgtttaaactctgtgctaaagagtgattatcacatgctgtttactttaaagctatatagagctttgtcttatacatgaattaaagcatttataaaacaaaataaattagaaaacagtgaatcagaagtacttgactaaaagcagcaaagtagcctcagaaggaatctgaacaaacttgacctagtgaggtataaagtacaaagatggttgaaattgagccaggagtgaagccctacctaccaggacatttaggttggaagatgtccatatctggagtttccttccatcagactcaacagatggacacggtaaaagttatgtgcgcatggtgtgtatgagagtatgtgtatgtgtgtgtgtataaactggacatgctgtagcatgtaaaaattgaattacttcttagaaatatttgcataatgcttttaaggcaatatgtttaactgatacacacttggaatggtgaaagtgtgaattagggacactgttccaaactatgaataaagtggtggtttcacccagcactagatccagatttgggagacaccttgagaattatctaatcagtcattaagttaacatcttttttttagagtttgttgtcatttatttaaagtggttacctcattttgtagttatcattacatccagacaataagggatgtggttgaatttcaaaagttttctaacttaacaagtcttattttgttagattatcctcacttaggtcttcatataaatttgtaactatttcttctgaagacatggagttttatttaaactactgtatttttgttttatcatagaacaacagaattcttattacagaagttgaaaatttttaatcactattggatattaactgaagttctgtttctaatcataatgatacatttaagtgcctacatgtggcatacatttctagattctttgagtaaaacatttgtatgacatcaacatctgtattgccatcaggagtgtcatttctactggcaggggcagccacctggaaacctgaaggaatcatctacccagaaaaagtgatagggcatatctgtggtactaatttttgctttatttctattgttcacagattggcttatacagccatttattcatttagaagttttctctgctaaggcaccttcctctcctatcgcaccactcaaaatttggcccatctttcggaactcagttgaaatgccattttgccattaagttgattgaaatcctctcaaatatttatgatctatcccttttcagaatgctagtaacttttttactcttttgacattctcttatgttgtgtcttgaatgacagttgttcctgtacagatcttagcactcttattagcctaccacgcctggaaagggctgtctgcccctttgtcatccttggcctcatctgacacacgacactatgccctccatgtgatgtcactgcctgtcaccttatgtttctatcctgcgttgtatactcacgttcttccatctcacttccctgctgtctcctgtctttctttagaactacattttcctctggtcctccttctttgagcatgtattatttttaatatgctccccatccatataatcctggctagcctctactcacttcttaaccacaacgctcatcactttaagggaagatatcttaaactgagagggtttggaataaagtggggaagtgggatttgtcaaacagaatgaaagcatgcatgcaggtgacagtcctgaatgtgcataaatgacattggaagaaagcagaaagacactggatggaaatgtgcaaatgaaagaagattccatggattgggagagcagagaagtgagaaatcatccttaagtgatgttcaagaagaacagaggagatgatattatctccaaatttacctgatcataagaagtatcttaccaacgtgttaagatgtagattcctgagacccgccacagtctagcaaattataatcccttgagacagcctgcaaatctgattttaagaagcttctcagtgatccctatgatatgaattttgagaaaacctggagaaattgatggtaatgtcacagaaacataaaatgttaagagaactggggatggagtagggataggaggtgggacaatttcttcctcttacaatacgggataattgggccaaaagcaggggtgcagggcagagtcctaatgcacaaagtgctttggcctccttaatgagcctgcattaactctgccagctgaaaatatttctcagtaaaatagggcaaaaggcttttacaataagattactaagattttgttaagtgtgtttgaccattaagggaaaaatgtgaaaagttgtgagatattttctactcctgaaacaatcatttcctattagcattttagtcataagtttacttcactagctcttatgttcttagtttcttcaacctactgcagaagaactgaaaacattattagagtaacatgatatgatgaaatcatgagatttcaatcagttttacaacagagctgaaaggtgatgttttagagactgtcaaattattttcagagactcacactagactatttcttactgaaaatatttaaatacagcagaatttaactcaaagttctataaaaagtacattttataatattggtattaaaatgtcttatatcagtactatataaaattgctgtttttgtttcagtctgaagactagtatagttagtgaggatgttaaaacttgacaagaattacataattcttacagatttaaattgatttctttcaactggacttatgcactggacttttcaaagagaaaagtatgaacaagggcaaattcatatttaaagggaacttttcattaaacactttgtagtctactctgtcatttttcctccaatgaggaattctatctttcgttcagtgcacacaaaaattaattgtaatcagcatttttgttgcctaatgtctcatgtagttaaattttttcttaaataaaaaataaatagtaatttgaaatttaaaatagcattttatggagaacagagtattaatgagccagcatgtaaaaatattttttcattttacaagaagcttatttaatttttaatattcaattccaaaaaatacaaagggataagcagaagcaaagtttggctgtgtgtattttataagtcacttactaaataaaacatttatttccagatattttctttagccacatattaatattcaacctagcctagtccctttgaaaattgttaacaactagattccttatttcatgtcctagtgatatgtaacagtaaaatgtgatttttactcaatgcataagtgagagatcctttgtttatttaatattttcatcatttccttgagtaaaaatgataaatatattatttaccaagaaaagataaaaagttctagctgactcttggcatgacatagactgtgtgatacaatccagttgtctcatgaggaatcaaagaagcctagagatctgttacagttgttactaaatatcctttaactggttctgtcctaattcaaagtattttcatgtactgcatgacacaaacaaacaaggtagagaatttttctgaatgtaatacaaaagtcagggtgtctcatttgaggaaagatgcactgttagcatttattttatctttaagcaaggtaataatttataattatgactgattcacatataatctgcagcaataacaaatcattaagcaatgaattgtgaaaggtaatgtcctagtaatttggttatttcagtacatcaggtgtttacttattcattttaactgtttcccaaattttgatatagttgtcaaataaaaccaaatgattgtaaggtatacaaggtgatgatttgatatacatatatttcgtgaattaatcaaattagtttacatgttttgcctcactgtgctgtatattagatcccctgaacatatttatcttccaactgaaagtttgtactctttgaccatctccctttttttcctgctcactgcctctgatagccaccattctactgtctgtttcaatgagtataacgtgtttagattccacatttaagtgagatcatgcagtatttgtctttctctgtatgacttatttcacttaggacagtgccttcacatttcactcatgttgttgcaaatggcaagatttctttcttttttatggcatcatatatatgacatttatatatatagagagatatcatatatgatatatattatatgccacaatatatattcatatatagaataatatatctaatataatatatgtatagtgatccaaaagataggtccaaattttatataatcatataataaatgtacaatctataattatatataatgtatagtataatataatatataatattatatatattattcaggggtggggatggggttggaatgatgttggtcaaagatacacaatttcagatagcaggagtaagtttaagaactctattgtacaacatggtgactatattatattatacaatatatatattatattctagaaaatgccaagaaagtggatgtaaagtgttctcaccacaaaaggaaccatgggagataatgcacatgctaattagctatatttattcttactgaaaaaataactgtgaagtaacatatatgttagttagctatatttagtcatttcacaatgaatatattcttttttttcctttccttttcttttttttttaaaagctaaatgaaagattttattagtcttgggaaaaaagacagaaacacaataaaaacttctctagtatgaacatgtgcaagtttcacaatcatgctattacattttgcactggcagacagttcaaggcgtagttatctgtcagcctgtgtcagatagcttggtagccagcagcagtcttttgaaaacacaaccaataaaaataccagatctaagcccaaggctaaactgacacagaggtcttctgaaaccaaattatggtagaaaatatgaagatgaggctttgataattcaaagcaagactcaccattataaaactgtatgatgattagggctaaatagttactttcatttaaataaaaatattaatacactgttatgtcagataatcttatagtattgagaattgaaatgcctgtcatgtacatgatgaagatatatgtaatggaataaatttgtagggttttttgggcattttgaaagtgtattttgtattattattgtccttttcttatcacaataaatatattcttaaaagcatcatgttatacagaatacatacaattttgtcaattaaaaatttttaaattaaattaaatattttaaaacataaaaatcaaatgacccttagatgttgaaacaatgaatcataaatgcccaactcatttaatcaaaaccacttttttgtaatgtattatatatttagatatataaaatgtgtgagtaatattataacacatatatttttaacattgagatcaaaaactaaaacactgttaaactaataaaaagtacaaatacagtaatatatttaaatttaaagaacttttaagcaactattggatgaaagatttgtgagtacaatttatagatgggcactaatgtttgcatttagtgcttaatttagttaagctagaaataaaatatagatttattgatactcacattgaaaaatagttaaaaatttttgagaaattcacatacaaaacctaatcctttaaacctcatatattttcccacaataacatgcttgcatttttcttgcttttcttattattgaatattgactatgtttaggtcctgttttaagcagtttacatgcagtgtatgttgtctcatttatctataacaagccaattaaatagatagcaattttcatggaaatactgtctaaatgacaaaagttatgttatgaaaggtggcattcttttttataactactagagaagggggtggaatgtagtcattttatctactatcatgttatttacctctaattgacaattttcacagatttaaaagcccttatatggtatttaaggacttaaatcagctatagtcttcttatctcatgttgaatagtatcttcaagctggctctataaataataagtgaatggatgagaaaaaaaggaagtgaaccaaatatgttaatggaaaaaatgttaacaaaaaatagaggattaatgaattcaacaactcttaaaaatcaactgttcaaactactttctatgtaagtacaatttgagtctattgtgatagagaagtaaactcaattcttgaatgtgatttcagtataactctgaaggagtctgcaatggtgattaaaggcagttattgcacaaggttaccaattacatttgttttcacacagctatatactttttttttttttcaaaatccttaccaattttcagaggaaagggttacggtaagctaatgtaccactagatccctttcagtttcattttcagagtgatagtaattgtttcatatgtgggaaggttttctgagactataatagtacatgcgtgattttgtgtgatttattcagaggctcatcagcttctttaggaggcagcaatgtaacagttctccagaggagacagtgccatagtgaaatatgggactaaggcactgcagatttagcccagacccttgactctgaaaagtcagaataatacatttagttgttttgctggacattgtgtaaatattttggaagagtgtgctttattttgctaagttcagaatgcacagtgggataatgtgtgatctggaacttgcccaatgtatgtaagagctgaggcacatcaacagagaggagatattggcaaaccttttacttgcagttcctagaaactgaagagctatgtaaccagaatatagaattactttcaatcataatattttagtatgagaatgagtcatttagcatcaactctttcaatttattgatgaagaaactaaggctcaaagaaattaagtgacttgctggaaattattactaaatggatgccagaatcagaatgaaatcaaaatgttcagattcaaagccaagtgctcttctgagtgcctcgtgctgcctcttacattagactacttctgacccacagattacattcaatttttcgacttataaatagtgttctcttttcatagccacaacatgaatcatacaggtgaaaacccatgcctttatggtaccacttcctttattatgtcaattatgtttaaaagtggtaaaatctagcctgtttgtgagtgccatagtttcaggaagagtagttttgtataggcattcttaaaacaaactttcatgcataattgtttatttaaattaaaaagtatgtaacaaaaagagaggagttttgcagtataatgtgaaaatgtgatcctgaatgagcaaaaaaaaaaaaaaaaaagggaaattacagcaggtcagattttatttttattgtgggcaaggactggtggacttggcactggtaatatctggttagagattttaaaatgtattcaaaaaagcaaatcaatgaaaattaaacaatctataaataatacttagccatcataattaaaacagctaccattataagacagacctatataagaaagggtgattttttttttgtttcccatctgactttggctatatcttttcagaaaatactttgtaaactttggaatctcatgaataatttagttattcatataaagtatgatcataaaaattaagaggatgcatatagaacagttgaattacttacacagggaatgtgactttattttatgaagctgtgggtcttgttgatttaaatagtttctggggttttttttgttcctggttgaaagattatgttgtattatgttaggctataattgtgttattcataggaatgaattgtataattatagtgtggtgacggcatgcaggtaaccatgactactactgttcttccatcaatttttgcttctttatgcagtggtgaatatttttagtggttctattatttgctcttttaaaacttagaaccaaaattataagtcatctctattaaaaaaaagtcttgcataattttacagggtcctccttttagatacttaggtatggaatatcaaaaaggaagctcatggaaagagatttctaatttaaacaaaaatgtgtatcagtggggccaccatcttcatttttctgactgtaatatttgcatttctggacatttttttctagccttcttctctgtgtaatcattaattcttggctatattttgtgtatcagatttctgaaaacttcctcttctgtttcattcacacaaacactattattgtttaggccttcaccactcatacttggattattaaagtaccattctgagtggccttcattttattcttaacagtatctatcctgggcttcatcttttcttactaatccttttggcttgactgcattctaaagtaatataaaactcacaaaaactcatcacaaaactgttccaaagctaaacatttattctttcagagactgtagatctcaaagtgaatataaaaatatttattctgtaaggagcattattttctttacagacactccaactgatgggttacaaggttacaaagcactgagtgtcagaagccttggaggctttttaggctacatagcagtgtatatcacagagaacatcacagattttgttgttgttgttgttccttttatagttatgaagtctactgcaagcagaatcacaaggtcaaggtcaaaggttatagaacatttttaatactactgtgtatgtagatggaaatacaaataagttatagctgctaattttgatgcaccaattttttattctctggtaacataaattacttgagataataaaattattcattattgaaacttcatattgaggtaaaattattctgttattgcagttgtagaatgttcccttcattacatgaaaactactcttacaaatcctagatccacttattgactctgatagcagagttatgacaaaatctgataatcaatagttatagcaaatagctcagtctttacttgcatatctcaaaaagcagaagtgtttccaaacacaacactaataaaattctctttccttctcacctctgtcattacattgcagaccttccacactccttagaaacttattctttcaccagctctaagtgatttttctccttttctacaccagattctttattatgtaaacataagtggcagttctctacaagacataattagtctttaatttacagaagaaaggagaagatgggactagatactctggctggatggaaaaggtgtggatatctatgaacaatctccagttaattcttttcaatcacaaaaataatggtttttgtaattagatttttgaaaacaatttttatgggaatatatatatcatgcaacagtatagctgactgtgctggaatttggtaacaaaacctttacatttaaacaggtctcaaagcaagggcattttttttctaggtaaaataatggcttttattttcactacaaaatcctttttaatctctcagattataatccagagacatctcaattgtcttcctccattaaaaaaatcttttagaccaatattttccctctgcttaattccatgtatttggaaggtaataacaatatcgtgcctcttatcatagatgggagaatttatcaatccatttttaaaacacctcatattttatctgttcacaattgtaaaggcattcagaagaatgtgcagtgacattatacaaaccagtcttgaaacctcatttatatcatgcattgtgaagaatgattatgttttgtttgtctgattttcaatcttgtatggagtaaaactttgaaaaatataacaaaaattagataaaataatagttattatatttatcatattaataatttaaagtatagcacaattgatgtggttagatgccatggccatattaaagtttttaaagctactttcaatgtcagtacatattcacttaagaggtaagacatagttctaataaatagttctctcaccagcaaacactgttaacagagacttcacaaggaggcatattttcaggagaggcttctccagactattcaactcacctgagctcctctgcaaatgtagattaatttttttttcttaactgatcacattattattttcttagggtgctaacaatgtcaccacaggccattgagcacttctttgtggactgacagaaggtgttccttcttcatgacagggtcaatactgcactgggcaggtggcttgaccagcagatgaagtgcgtgttggcctccatcgtcttccaactgtgtgcttctgggctgggacacgaccttcagcactatatgcagcagctgtcttacctggtccctctttctgatttcaatgcctaagtttcctttaattcattctcagcctccactgcagaggaaagcttggcagtctttgggcacaagaagttgcatataatggatgaggaatgacgttttaaaattagatttcataaagaatctagaggaggcatctcttactacctacgctaaatgagattccatctcttaattacattttacaaaacataagaggcattttacaaaatgtttacaaagtgtatcttctcgttaagctagtttatgtttctatttaatccagctcacaaggttagggtgagtataggattgggttttccgggttcaggaaacacttcaaaggaaatcatactttgaacatgttatctaaagttatccatgattttatatatatatatatatatatatatatatatatatatatgtcaacctaatataatacatataattatatataatataatatatctattataattatatataatatatatttatctattataattatatataatatatatttatatattataattatatatgattatatatatttataaatatatatatttttgtaaaaagctttgaagtatttataaaaagcagctgtatagaagcaaataattattcactgtcttatgttgacagcatggaacaaaaggcaaaatcatgactcatgaaactataaggtgaatatatgtcaaatcttttatttaactcattaattaataagagattcagtaaaatcttaggaccagctcaaaggaaacatttaaagaacataggcttccattaagtggaaataagtttgttaatatatgcaaaattagttaataacctataaagtaataaaatgtcagttttctagaaaaggaaaaccaattatatctcaatttatcagatgtaatttatttgcatttctatgaacaataattattctcatgacaatcagtcttgtgcaagttaacttctacttttacattagtctagataatagaaaatcggttaaagttattcatccctattgaattagataatccccagatagtctatcagacagcttctaccactttgttgaaatgatgcccagtaatttcatttgctgatttccaaatcttagacatttttcttgacacacccaaatatattgcatcagacaaccagtctctaaagttaaaaaaaaatcacagtttctatgtattttttcattacacaaaaaaccaaacagattcttgaagtcctactctgaatcatataaagttaatctgtgagcacccaaaaaaaacagactatcctcagtatgctcgccatttcactgagaatttcattgatgagccttgttttctccacagatactacatctgcccatgctactaagtctcagatcaattctgagaaagacaaagagctgtattgatctaacaaacacatattattgccacacatttcttaccaggtctttcctgatgcttataacattcccccaacactgtccctcaatcactcactgattccagcacagttcatgcagctggtggcagacttggttctctctcattagcttccaatatctcccactctccacattctcaccattatgagaataccttacccctacttaagaagaaatattgagaccatctggcatgatatcccgcctttattcccatctttcactcagagcactgctcatagaatcctaccaaaaaggaaaagctttcctttcactttcaagtagacccttacactctatctgctcccatctccttgaatgtagcccatgtttagcccctctgtcttaagtaactttcatttttcttttccagtgatgttttccttgttacccttgaacatgttcaggtttctctcatgctcgacatttttacctagattagctacccttctcactgtgatacagggtcatatacctgccagactcctggatcatgagtatcctaatttgctgcttccacaaggtacttgcccattttatcattaaatttctggatttgaggtccacatttgcttgacatgtgactaaaattctgttttcaaaggttatcctttggtctcagaattcttctgcaatttttgacattttgattttcacttttcttcttttatctataacacagcactttcttggttctctgacttctttatcactttcttaatctatttactaaaacatttatctgttatcctttattcttgatttctaatcattctcaatatgtgatccatagtcataatttcattgtttcaattattgaatcaaatatatgtatccactctcaatcttctcaatttcaatcacataattccatttgctcacaagataaatattttcttagggaaatttaatacctgtcaaattgaaaacactatatatcttgacaatggagcttctttcgtgtcaacctaattttaattgatgtgcaatggactgaatgtttatgtgtcccctcaagttcaaatttgaaatcttaacccccagagtgatggtattaggagaaggtggggcatttgaaaagtgatgagggcatgaaggcagagcttttatgagttagatcagtgcccttataaaagaggcctcaaagagatccctaatctcttccaccatgtgaggacacagggagaagatgctgtttatgaaccagaaagtgggacctcatcaaacaccaaatctactggcaacttcctcttggacttcccagcctccagaactgtgaactgtgagaaataaatgtctgttgttaataagccacagtgttatactattctatggtgttttgttatagaagctgaaatgaactaaggcagtgttaacacatctttccaaatcccatgggagagaagaatgtcttttaattccctatacacatttttactaaatctcattttccattatttcctcagctctaaatctatcaccaaattcttttattaagtttatatttactattttttatatctattattgtatatacatatgttatttcccatctagattataagccacctaaacaaaaggactgtttctcttatcttttcttggacctttggaacaattactgaataataaaagataataatactaataatacattgcgaagccttacctttttcaagtgacattaacatttatttttaaatttaatttcataactgacactcagagaagtcaaagaggcattgctataggattcacagcctataagggacagaaacggaaccaggaattgtttctaggatacttcttcattacagtattgattaagtggctggtcaacaaaatgatataaagtggggaaaaaagtaacccatatttacccgttaaagttgattgttactcattcttagtagagaggttctctctttctctctgtctcttttacttctggtatttaggtaacatgaaatttccttggagggttcctaaagcaagtaaaaatttagaaacttgagaagcttccatactaactgggtaacaacaatttgctcactgaaaatagtttcaataaaagcacttaatgggtttttttgcactactcagaaaggcaaatctttctgtattatttactttgttttcccacccaaaacaataaaagtagatatttttgatgtaaagagttacatgttgtaaagctctctcttttaagggctgcatttcttttctaccattataaagcaaacattattttgtgtttcaaaccagaatctaaggctgtggaaaagtcagataaaatttagtgtttcaaatgttatgttggaacatgtttctcctataaaatcctagagtttgattgctgtgttcctacacaggaaaagtccacaatgttctgttgtaaagagttaatttattattgggcaaaagtttttgattgactccaaataaaattatgtattagtccattctcatgctgctatgaagaaataccagagactgggtaatttgtaaagaaaagagattcaattgactcagagttctccatggctggggaggcctcaggaaacttacaatcatggcagaaggcacctcttcacatggtggcaggagggagaatgagtggagaatgagtgcaagcaggggaaatgtcagacacttatagaactatcagatcttgtgagactcacccattatcatgctaacagcatggggaaaacccttcccatgatccaattacctccacctggtcctgcccttgacacatgggaatcattacaattcaagatgaggtttgggtggggacacagagccaaaccatatcattctgcccctggcaccttccatatctcatgtcctcacatttcaaaacacaatggtgccctacaaacagtacccgaaagtcttaacttattccagcattaacccaaaagtccaggttaaatgtctcatctgagacaaggaagtcttttccacctatgaacctgtaaaatcaaaagcaagttagttgcttcctagatacaatagagatacaggcattgggtaaatacagctgttccaaatgggagcaattggctaaaataaagggctacagattccatgcaactccacaacccaatagggcagtcagtaaaccttaaagttccaaaatgatctcctttgacttcatgtctctcatgcaggtcacactgatgaaataagtgggctcctatggccttggggagctctgcccctatgtctttgagagtacagcccccctcgcagcttttatgggctggctttgactgtctgtagctttactaggtgcacagtgcaagctgttggtggatctattgttttgggatctggattatggtgggcctcttcgcacagctccactcagtagtgctccagtggggacactgtgggggatcaaaccctacattttccctctgcagtgccctagaagaggttctcaatgagggctctacccctgcagcaaacttctgactgaatatccaagcatttccgtacatcctctgaaagctaggcagtggctcccaaacctcaattcttgacttctgtgtactcacactttcaataacatgtttaagccaccgaagtttggggcttgcgctctctgaggcaatggcctgagctgtaccttgacccttctagccatggctgggacacaggacaccaagtcctaagactgcataaagctgaaaggccctgggccctggccacaaaaccattttttcctcctaatcatcagggcctgtgataggaggggctgccgtgaagacttctgccgtgccacagagacattttccccattgtcttggtgatcaacatttggcctctcatcactcatgcaaatttctgcagactgcttgaatttctcctcagaaaatggatttttcttttctattgcatcattaggctacaaattttccaaagttttatgctctgctttccttttaaacattccaagccatctcactcaagttcaaaattccataaatctctagtacaggggcaagaggccatcagtctttttgctaaagcataacaagggtgacctttgctccacttcccaagaagttcctcattgtcttcttgagaccacctcatcctgaacttcattgtccatatcactatcagcgttttggtcaaagccattcaacaagtctctaggaagttccaaactttcccatattttcttgtcttattctgagccctctaaactgttcaaacctctgcctgttacccagttctgaagtcacttccacatttttgggtatttttacagccaacgccccactactcccagtaccaattttctgtattaatctgttctcatgctgctatgaataaatacgcaagactgggtaatttataaagaaaagaggtttaattgattcacagttccttatggctgggtagccctcaggaaacttaacaatcatggcagaaggcacatcttcccaggatggcaggagagagaatgaatgcaagcaggggaaatgccagacacttataaaaccatcagatctcatgagactcactcatcatcatgatgacaccataggggaaccgcccccaagatccaattacctccacctggtcctgcccttgacacatggaaattattacaattcaaggtgagatttgggtagggacacagagccaaaccatatcaagttatttcaatattttgtcctgaaagtggtaagattttatcagagaaaggtaattttaaataagccatgctcctgcgagcagttaagagagaagaaacatatgagaattagaaagctagtactcactataaaaaaaaatctagttaatgaatatacttcacttaaaaatgagatattgaatctaccagcatgatctctaattttggcctgatggtggaaaggtaacttctatatacaatgagaatctatttatgtagaacataccttcctttctgcaattaagttgggatatctgagattctttatttttattttttaattgacacataataattgtgcatatttatggggcacatagtgatgttttgatacatgcaatgtatagtgattaaaacaggttaatattcacagcatctcaaacatttatcatttctttgtagggggaacattcaatattctctctttagctatttgaaattatatataattgataactctagtctagaccgttagaacgtagttctcctaactagctgtaattttgtgtcctttgacaaatctctccctttctcctcctttctcctaccctttccagcctttagtaatctctgttctactctttacttctatacaatcaactcttttaggttccacatatgaatgagaacatacaccgtttaactttctgttaccagcttattttatttaacaaccgcagggtcatttatgtcactgcgagtgacaggtttcattcctttttaagagttaagcacttgagttgactaagtatcttggcattatgaatactgctgcaataaatatgggggtgcagatatgtctttgatatttttattgccttcctttggataaatacttagtagtggaattgttgaatcatatggtagttctatttgtagttttttaggagcctctatactgttctttatagtggctataatagtttacattcccacccacagtgtataagagtttcctactctctgcaccctcaccaacattaattttttttctttttgataatagccattctaactgtggtcagatgatatctcactgtgattttgatttacgtttccctgatgattagtgattgaactttgtttttgttgtttttttagatggagtctcactctgttgcccaggctggagtgcagtggtgtggtgtgatgttggctcactgcaagctccgcctcctgggttcatgccattctcctgcctcagcctcccgagttgctgagactacaggcgcccgctgcgacgcctggctaattttttgtatttttagtagagacggggtttcaccgtgttagccagaatggttttgatctcctgaccttgtgatccacccgccttggcctcccaaagtgctgggattacaggtgtgagccaccgcgcccagcgattgaacttttgaaaaatatatttcttggccatttgtatgtctctgagaaatgtctgttcagatcatttgcccattttaaaatcaaattgtttatttgctgttgagatgtttgatatccttgtatattctagatgttaatgttcatcagaagaatagtttgcaaacattttctcccatttcataggttggctttccactctgttaattgtttgctttgttgtgcagaagttttgttgcttgatataatcacacttgtttttgtttttatcacctgttcttctgagaccttattcataaaaccttttcccagaccgatgttctgaagcatttcccctatgttttcccctagtagtcttacagtatggggatttacatttagatctttaacccattttgagttgattttttgcataaagtaagaaatggaggtctgctttcattcttctgcatatagatatcaagtgttcccagaacaacttaagagggtgtactttccttagtggatatacttgacacctttgtcaaaagttagttggctgcagctatgtgaattacttcctgggttctttattttgttccattaatctttgtttctgtttttatgccagtatcattctgttttggttcacataacttggtagtatattttgaaatctggtaatgtgatgactgtagctttgtttcttttttctttttttttaattattttatttttattttatttaattattattatactttaagattttagggtacatgggcacaatgtgcaggttagttacatatgtatacatgtgctatgctggtgtgctgcacccattaactcgtcatttagcattaggtatatctcttaaagctatccctccccgctccccccaccccacaacagtccccagagtgtaatgttccccttcctgtgtccatgtgttctcattgttcaattcccacctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgtcacattttcttaatccagtctatcattgttggacatttgggttggttccaagtctttgctattgtgaatagtgccgcaataaacatacgtgtgcatgtgtcttcatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctggctttgtaatgattgccattctaactggtgtgagatggtatctcattgtggttttgatttgcatttctctgatagccagtgatggtgagcattttttcatgtgttttttggctgcataaatgtcttcttttgagaagtgtctgttcatgtcctttgcctactttttgatggggttgtttgtttttttcttgtaaatttgtttgagttcattgtagattctggatattagcgctttgtcagatgagtaggttgcaaaaattttctcccattttgtaggttgcctgttcactctgctggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaagggatccagtttcagctttctacatatggctagccagttttgccggcaccatttattaaatagggaatcctttccccattgcttgtttttctcaggtttgtcaaagatcagatagttgtagatatgtggcattatttctgagggctctgttctgttccattgatttatatgtctgttttggtaccagtaccatgctgttttggttactgtagccttgtagtatagtttgaagtcaggtagtgtgatgcctccagctttgttcttttagcttagattgacttggcgatgcgggctcctttttggttccgtatgaactttaaagtaatattttccaattctgtgaagaaagtcattggtagcttgatggggatggcattgaatctataaattaccttggcattatggccgttttcacgatattgattcttcctacccatgagcatggaatgttctttcatttgtttgtgtcctcttttatttcattgagctgtggtttgtagttctccttgaagaggtccttcacatcccttgtaagttagattcctaggtattttattctctttgaagcaattgtgaatgggagttcactcatgatttggctctctgtttgtctgctattggtgtataagaatgcttgtgatttttgtacattgatattgtatcgtgagactttgctgaagttgcttatcagcgtaaggagattttgggctgagacaatggggttttctagatatacagtcatgtcatctgcaaacagggacaatttgacttcctcttttcctaattgaatacactttatttccttctcctgccttactgccctggccagaacttccaacactatgttgaataggagtgttgagagagggcatccctgtcttgtgccagttttcaaagggaatgcttccagtttttgcccattcagtatgatattggctatgtttgtcatcagaattgctttggctatttgggatttttatgattccacatggagttgaggattatttatttttctttttctgtgaagaatatcattggtattttaatagagattagattgaatctgtagatagctttggatagtatggccattttatcgttaataatttttctagtccataaacatgggatgtctttctgttatttttgtgtgttcatcaatttctttcatcagtgttgtatcatttttcttatagagattgatcaccttcttggttaaatttgttcctaggtaatttttgtagccattttaaatgggatttcttttttcagtttttatttcagctagttccttgtttgtgtatagaaattatgttgatttttgttggttgatttttttcttctgcaattttgctgactctgttcattagttctaaaagtttttgggaagagcctttagatttttctatgcataagattgtgtcatcagccaagaggaacaagctgacttcttcctttttagttgggatgccctttattttattatcttgcctaattgttcgagctaggattttcagtattgtgtttaataaaaggaatgaaagtgggcattcttcgcatgttcgatatattagaggacaggctttccgtttttccctatacagtatgatgctagctgtgggttcatcatacatgaactttattgttttgaggtatgttccttctatatccagtttgttgagaatttttgttataaacagattttaatgttatcaaatgtttctgcatctattgagaagatcatatgattttactcttttattctgttgatgtgatgtatcatatttattgatttgcatatcttgtaccatttttgtgttccttgagtaaatctcactagatcatggtttgtgatctctttgacatgtttttgaattcaatttgctaatattttgttgaggattgcatccatgctcttcaggaatattggtctgtagtttttatggagtttttttgtagttattatgtccttattggattttggtatcagagttttgctggccttgcacaattagcttggaagaattccttccccttcaatttttggaatcgtttgagaagaattgttattagtttttcaaaattttgatagaattcagcagtgaagctggactgtgctggaatggtttttgttattgactcagtcttcttagtattggtctgttcatattttctatttctccttggttcaatcttggtaggttgtatatgtccagaaatttactttttctctaggttgttcaatttgttggatacagttgttcattagaatctctaataacctcttgcactcctgttctatcagttgtaatgtctcctgttttattcctgaccttatttatgtgtgtcttctctctttttagtctagctaatggtttattgaatttgtttatctttcaaaaaagctaactttttgtttcattgatcttttctattttgttagtctcagttttgtttagttcttttctgagccttctcatttcattctaccagttttcggtttgctttattcttgcttttctagttctttagggagcattgttagtttgtttgtttgaagcttttctactttattgatgcaggcatttattgctataaacttgcctcttactactgcttttgctgcatcccataagttttggtgtgctgtgtttttattttaatttgtttcaataattttttaaatttccttctcagtttcttccttaatgcattggatgttcaggaacatgttgcttaatttttatgtatgcatattttcagatattcctcttggtatagatttttagttttattctattgtggtctaaaacatacttgatgttatttcagtttttgaaaactttttgagatgtgttttgtattctaacatatggtcaaatgtgaagaatgttccatacactgatgaaaataatgttttctgcagctgttggttgaaatgttttgtaaatatctattaagtccatctggtctatcgtgcactgtaactttgatgtttctttgtggattttctgtatagatgagctatccaattctgaaagttgtgggtgggttgaagttcctattactgttttgtggcacaaccatctctttagatccagtagtatttaccttataaatctggaccctccaatgttagatacatatataattattatatcctcttactgaattgatcccttatttattatacaatgtcctttttgtttctttttacaatttttgacttagtctgttttagtatagctacttttgctcttctttggtttctatttgtgtgaaatatgtttttccataacttcactttatatgtttctatacaggtgagctgagtttcatgtagacagtatataattgggtcttatttattcagccagtggatatttttgattgtggaaatataatcaatttatacccaaggatattattaatatgtgaacacttactactgttttttattcttttctcatcatttcgcttcatattttctctcttattgtttatttttgaagtttgatggtttttagtagttataagttgtgacaatgcagccacccatgtgggcttgctgtaataaagatagaacctttctctttcttttttgtacataagcaatattagtgagtttcataatttagtgtgttttcatgatgatatttactgtctttttgcttccagatgcaggactctcttaagcatttcttgtaaggccaatctagtgatgataaattcttttagtttttccttgccaggaaaataatttatttcttattcatttctaaagtgtagctttgctgggtgtagtgttcttcactttcaattttttgtctgtttgttttagtattttgaatatattattccgttctcacctgacctttaagatttctgctgagaaatctgttagtgtaatggggattttcttatatgtgatttgatgcttttctcttgctgtttttagaattatttgtttatctttgacttctgtcaattagactataatctgtctcagagagggtctgtttggcttaaatctattttgtaatccttgagctttctggatgtggatatacacctttcccaagacttggaagttttcagctattatttcatttaataggttttctataccttttcacttattttcttgtttaggaattcccataatgtgcatatttgtttgcttaatggtgtcccataaatcctgtaggctttctttgttttttattcttttatgttgtatattttaattttgctcattgaattcttcagctgtaagtgttttgggttatttttatgatgtctatttcttggcttaatttctctttcaaaacatgaattgtttccctgacttcatttaattatctatattatatcgcactgaatttccttaagattattattttgacatttttttcctggcatttcatctatatcctgatgattattatctgttactagaaaattactgtgttcttttggatacgtaatattttcctgctttttaatatctgaggcatccctacactgatatctatacatgtggtagaatagtcatcttttccagttttatggagttgggttcatagagaaagacttatttctatagatggtcttagaatatcagttgaatgaggtgcacgggctttgattctaggtggatgcagtagtgcagtctttgtacattttcttcagcagcaatccattttagtgatgttttcaaatgtctcagtggcctgggctgaatatatggtggcaatgctgtggctttgcaggaggtgaactcacaggactatgtctcaggccaagggtacaaacatgaacatgatggatcagccaactgagggtgtgattcactatggttggggtgcagggtggttactctggctagggccactgttgcttggttgtctcaagggtgtgtccactgggctgtttctcaagccctagatatgggcacaaggccactcctgccaacctgattgtgtgtctgctgatggtgggcatgccaaactgtttgtcacactctgggcacaggtacatcactgctaggccagtctggtggcatgtttgctggaggtggcctgtcaggttgtttctcaggccctgggtgcagttgcagtgggtgctggtttctctgctgtgtaggacaggagtcagtcaatcctaaacctaggttttgagtagccagagttgcgacaacacagccacccatgtgggcttgctggaatgaagatacagccccagtgctggggaggtaaagtggctactggctcccagagcatagtgctctctagaagtaggtccagtcttaagattgtaccatgttgcagtggcttgggacacaaagggtcagtagggaatggggaattcacaccttgttctcctaatcagtagtaatgctgctgtgtgaattcctggcagctctctaaactgggctcagggctttcaaggactgtgggattctcctgtagtaaggactacaagtgtttgtggtgacagtgggggttggtggagtttctccacttacttttttttccacgaggggaagtctctcttgacttcaggttgatctcatcataggagacaggatagtagaggcaggatggctcattagtctctctacagtgccctcctggacttcggagcaccacagggacctctcatctcccctgctgccttctagtgctctctcttcaatactccagttaaattctatctgtttattctttgccttgtttcttttcttatggggaggatgagtgtcatgtgcctctagtcagccatcttgctgactttacattacgaacttttaaataggtatgttttaaatagtttatatgaaatcccagtaaaatctgtaaacaaacaattggaccttgatgaaggtggagatgatcctgattttctttattatccggttatgtctttgtttttattgttgttttgttttgccttcaattactatatatttttcctaaaatttcaaattgtttatgaaaatgtgatttaagtatgtcagtgtggttttgctctgaaggattactaaagggcacataggcttgtaggacagtgttttctgtaactccctagaaagaaggtttcttcatcaggagtgtcattctatgaaagaaagcttatgtgttgctttcctaattcttaaataagagcaagatatcacagaaatacttaactgttgttaacatctaccttttgcttatcgatgaaagagaacatgagctatcacatgtgagtgaagcaaggcagaacgataagtaggagaaaggaatggttagataggaaatgcaactagaagggaaaataaatgggaactcgaatattttaaggactccatcttaacccatgttaattcataagaaaaatcttacacattaggagaaaaaataactagttggataaatacacatgcacataaaaaaataactttcacaggattttgtcattaaatacatttagagaagttagcctgacccatacttctgatttcaaaatccataaataccaacatatataacaaaatgagatagtataggaatttgataggaatatttgtttcttcatatattagtaatattccaccagttctaccatcccatttctaatatttgaatagatgggtggtggccactctagatattcattttataaatgcaatttccaacagttagctgtatcatgtgagttttcctctatagtgctgactttttcaccagtgaactcaattggctgtttgttcaaattccccactgaagaaactaaagacatgtatttaagttcctagtgtaaaaatgtgttgagacaatagatgaattcatttactgagtatgctggccagtatgacttgacacagattaacattctcctacttctgtggaaaataccacaaatactttgctctgttggtggtatagaaataaaataagatgatacatgaagtttgtctaaactgtagatggcattttggtccttaaattggttaattcctctctaataaccatttcagaatatttgagcattttactagagtttatttattttttcactgggtatgtagacttgcgaaagtcttaaaagtctctccatatcactagataaagaaaaaattcatttgttcctaaccacaaggttcagcatttgtatagatttgcatgagaaacacagaaaatccatgcagagacaatgttctttacaatgctttttcattaaatatctttcatctctgttcttgattcctattttagctgctctttcctgtcagacctgagctcatatgcctaggagtttttgactgaagcacaacatcactcttgcctcatttttcatgtcacaattttcccacagaataggaagttttaaactgataataaattacaatgaaaccaagctgacatagaattcctagcttgctaaattgtgggcagcaccctgccaagtggaaggtgtctagagctgcactgtgaccatcacatatgttctcctacattccatgactatatttcttaatgcttcacattttgcattaaaacagtgaagacctcactgccaaacagctgtgattttgcagagctctcatgtctaataatatcccactggctagatgagatataacgtagactatgaataaccacttatttgtggttaagaaaaagcatacatggcttctgcttctgatagtgtccactctgtactttcctttgcaatattagatagctattaatttttcaggataatacttagggtacaaagaagtgtatttcattgcttaactcatgtcaacttattatggggctttagcttctccctactcacttgataattttagctcacaaacttagtgtttcccttccttttatatgtcatgaaacatgcagatgataatatttgtttggcatattggcatcggagtaaaatgaggctgtctctaaggttctgttcactacaaagtctggacaatcattatattagtatacatttggctgtttattagtggcatattcattaggaggctttgtaactacctctttactgacagttgctaagaaagctattacttttttttttttttttttttacaaaaagttttcaaagtcctctcagagaagagtatcattcttgaaaaaaaaaaaaaaaaaaagatgtgaaattaagagagtatccagtcctttaggttgtctagaagtcctggctgataccacattccatggacctgtgtagtctatggagccatcaactccccattcttctggttatacaaaatgatattgaagattctcgcatgttaaaatttatggagagtaatctctgagattactgttctacctcaatcacaattatcccagaatataagaaatgaaaaaaacaaacaaaaatggtccacatttttgtccaggagggaatgaggacagatgaaagctttgagcgactaattacacccatacctatagatgcagccgtacaacccacatgaccagtgtgtgatttgctcacttataccactccactcctcttctaaagtctttccaattttcttttcaaagcttactatacatttaaatttgtgatataatgattagtcttaagcattttattgattctcaagtactcataaactgagtttgagttagcagaactcagagtcagagatgttttaaattaactcaattatgatagtagtcatagactttttgctcttatgtggaatttaagtgggtggatactgtaattattgaatgacataagttttgttatttgtaatgagttaaagtctaaatgcaaacttaaacatattacagtttgagtcattagcttattaattttttatgaagctattatctatcttaagagcttggagtctaccaagtaattaaggcaatgtctccaaaaattatactattataaaaaaatgaaatttccatatgtttaatgtttcaaaagcaattatgcacgtttgcccagtgttatttagaacaaacttcctgatactataaacgtcccagaaaaacttgttttttaaaaaacaaacttattatatgttatctgacattgcccattcatctatatactcactcttagctattggcatgttgtcaatacaaagtgctaacagttcataaataatttgacttctcttcctctcccatcttgagatcaaaatattccctaagttcagctattatgtctcatgtgttatttgaatccatcatactatttaaatccttttgtttccacagtgattcagtttcttgccctcttgctcttggatcatggtagtaattaactatgtgtccaaactattttttactctactgaaattacgatttttaaaaggcaaagctaattatattattcactgacttaattataaattcactgccaaagtttcctataatctacaagttatgtttcaaactccttagcaaatttattgattaactggcccctatctaccccttcaccctgaaaccacaacttccttctccttattacatggtttacttttaattacatcagctgtatgcatgatgcattccttcaacaaatgtgcattaaatccccgtaatgtgccaagtgctgtgctaagcattggtaatttaatagcaggcaagtgaaatatgtcctcaggaagctacaatgttctaggcatgaatataacaaaattggcaatagtaatataccataacaagtgatatgatgtgcttaggagtaatgctcaataattagataggtcaagagaatggaacggggttgcccatgtaggggacaatagcttacacatttgtaattatgtttgtatcagagacagcatggaatatacaaagagctgggacacggttttgctaaagcacgggggtacacacagggggaagagcacagtgaagtggcataatatgattacatttgtatttttataaggtttatttgatttctttgtagagaataaattgaagaaaggccacattagatgcaggaagacaaactggaaactattccaaaaatttggttatgaaataatggtgacttgacctgggtataaccctgggtgtggtgagaaaaggataaatttggtaaacatttcagaggcacaaatgatagaacctaacgactgaaatgatcttgggaaaaaggagaatgagatagagaggatattgtcctggtttgtggcttagcaaatgagtttcctgatggtatcacatactagtagagcaaacccaggagaagtgagaagcctgtaataaaagatagaagttccaatttagacacgatgattttaagatttggttggacacccaaatggagcttttggtgaagagatgaatatggtggtctggctcttaggaaaaaagtctgaaccactgattcatattcagaaatctttagcataaagatattctaagaaagtggataacaatatccaaggataatttagagtgagaagaaaagttggccttagaataaaattcctgagaaatatcaatatttggaacatcaataagaaataaagagttgacaaatgaaataaaggtgaggcaagaagaaagtgattataaaaaacccatgagagagagtttagaataatagatcaaagaaagtaaaacactgactgaaaagtatccactggattgtataaaaagcaaatcattttttacatgcaagataatgataaagttgaacatgtttaaatgctgcagaaaaaaagccagagagagagagagacagagagaatcttctctggaagatacagggaataaaaataagagtccttaaagctagctctctgaggatgttcgataggaaaaggattctgcacaatggtagatggactaaccttaaaataagagaatttcttccattgtaataaaacaaaacaaaacaaaaagatgcagttgaggttgtgagtttagcatttataacagaaaaacaataaccttagatttctcagcccttctttccaccctacaagaagctaattacattttatactttcaacatctattcagtaaaactacagacacttttatgagagttcagtggccaaaatagagaatattcttattcatattctctcgctctccctctctcattatgtataggaagagagaacctctcccaggtgggtctgcactgttatatgtgagccttcaatgtgaaaacgaagaaggtcatgaaagctcttctcagacaatacaatactttttgaacggcaaggccctaaaatctagagatcaattcagggaagatgcaaattttggtctcatccctgaactggtcagatgagtgtccagcccaagagctcttatattacttggtgcaagtgcttatgccctcaatgttctgctttttctagtgggtaaaattaggcagttggtcatctccttgtttgccttttctgcagacaaagaaggctgtactggaatgtcagtttgtgaatccttcaacgttttaccactggaatttgtttgttcttgcttgtctaataaagtgctttctttacatatttactcaacccatgattcctgacctcatcatgtatatccagcatgtgacctttgaaacatttgagtggtacataattatagagtggtttgttatgatagtgatatatttttaaaatgtcaatatataacaaataatataaatagtaaggaataccctgaagtgagcattttatacaataatcttaacccaatattggcaggaacttgagttaattacaaacagcaacttgattagcttgtgaaatagaaagcagtcatatgaaaagagtgagcaagaaagttgtgcatttggaaatttcaggatgatagaaaacattaaaatggcattgaggagaaagctctagaaaggtaaacaagattgctgagcagcttcaaacaccagttgaggttggaaactatgaagatatagttaacttactgtgtgcaattataaaatataccgtgtgggtggtgcatttgtggggccattttgtggtttttgaatgccgttttctacttcatctgttcattcatgtagagaaacttaatcctttaagaatcaactcatgtgcctcattctctgtgatttcttctctaatcatcgagcagggcatgccatacagtaagcgtgccataaatgtttcttgaaatgattaaaattatgctttgtttgtgctgacccttttacagtgattttagtcaactacttatgttctttgttcttcagcttccttacttgtcaaacatgaataataacaatgcctatttcatagggttgttttgtggattaaatgagttcacacatataaagaacctgaagtagtacctggaacaatttaagtgctcaattaaaattaatcatgataattattattatcaagcaattgttattattatatttaattctatgtccatcacttatttacaggaattgatctcctactagcctgcaaattatttagcaaagtggtccttttgttttcaagaacttactatgagcttgacatagaaccagcacacataagtgcttatgaacaaatgaatgacaatgaataatagctgaatgttttttggaaaagctaatatttgtttgtttgttttgagacagagtctcgctctgttgccaaagctggagtgcaatgatgcgatctctgctcactgtaacctccacctcccgggctcaagcaattctcctgcctcagcctcccgagtagctgggattacaggcatgcaccatcacacccagctaatttttatatttttactagaaatggggtttcaccatgttggccaggctggtttcgaactcctgacctcaaatgatccacccaccttggcctcccaaaatgctgggattacaggtgtgagccactgtgcctggcctagaaaagctaatattcacagaagaagaatatcctgagatgtaatatgggattaagggaaaacatacacacaggctttggaatcagactaagtttctagctgggaaatcctaagcaagctatttaattttcttgagcctcaagttgttcatctgtaaaatcaatataactgtactcaactcatagagtaatgatgattgcatgtattttatactaaagatgtagatgtttggttattactctcatcaccaacttcatcagcggggtcattattgtcattcttatggtcatcagattgaccttttgattaccagacttaacataatgatacaaaacacctcagtaacagcttcctaaaatgtaactttcattttaattagattatcctttcagtaatgtaattgagtgttagaagctggaatgggggctgctgcttaggaatttcaggtggtactgtattagtaatattctgatatttgtctacttaatgagagcagcaattcagtacaaaaagaaaaggctctgttttgacgtaaaaatctgatatataaagagtcttattttgggaacaaaacaactaaatatatcagggttgtggttacgttaccagctgcaagcattagtcatgactgtgttataaaagagttaattaaattctttgggtgaaggaggtgcagaaggaagtcaacacagtcttctgatgagatgagtcactgtgatcatatcagaaaaaagcacaggagctgaagaaagtctgggtcccagactgatgccatattgcaggatcagcctgtgtgaaaagccactgaccaataggaagctcagacaaaatagtttagtgtcatctgaagtctcatcaatacataagcagtttgaatttgtgtatgcaattttatttagcatattttcaaggaccataggagaataaacgtccttggattcatgactattgctgttgaagagtgggtttgggtataatgagtaatttcttcccatactaaataatattgctatatcagagagtatattgatttattaattaatatgtatgcttgatcatgacaaaaaaaacaagatgaaaacatgtagatttatcaagacttctgttagcctcatgactttccattctgctgttatgtgttgcctacatctccctcactcatcagtcttgagttttatgattctaatctgtcaaatatcttaactttttttggtccagcctcatctctcaagtaaattttagaaaacggtgttttccatttcccttgtctttttcctaatttattttccacattatgtgaaaaatattctgaaacccaaatcagtcacataatttctattcaattgctcccttttgtcttataggttcacttagcacataataaagggccatttgtgatctgaccttgaccctccagttttaatgaagtgtggtttctccctgcaatattatgctccagctatagtggtagctgctaaatgtattattcagtttcttggtgatgttcctttgtaaatgttgtgagcttttcttggaatgcccttcctttggccttcattacttagcaaatgctggttttcccttaaaaaccctgcattacacactggggccttttgggggctggggggttgggggagggatagtgtaaggagaaatacctaatgtaaatgatgagttgatgcgtgcagcaaaccaacatggcacatgtatacttatgtaacaaacctgcacattacgcacatgtaccctgcaacttaaagtataataataaaaatatatatgtgtatatatatatatgtgtgtgtgtgtatatatatatatatcagaaataggaaaaaaaaaaccctgctcagacatttcctcttctgtaaaactttctctgactatacccacctagactcaattaccctttgcgcacggcccctgtgtcaccatgcacaatatttcattatggcagtcttcacacactcttataatcatttctttgtacaactgccttcttcaataaaccctgagctatttaagaacagggaacatttttctctcagtctccaaaaagcttgtcacaaggtagaagacaaataaaattttgttgaacttaatttctaagtgatataatatggataatgaaaaactttttcagtggagtagtgtaaatggcagcaaaaacatacatcctaattttttttccttgttctgccattaaaatttacaggatgtggaaaaggcaaatattttctttaggcttctggtttttgtttttttttttttcccaaatgtacagcgaaagatttgaataactaatacccaagtcccttttttacaaacatgtattatgactttgtctatactgagacactctcttaaaatagtagtatgaccttattttataatttaatttatatcatttcatgttgaaagtgaatttacatctttaggtaataggcaaccttttcaaaaatcaatgtcgttctgaggctgagattcataaagcaaatggaattgtttagcgtagctagattttatttcatattgacaaatgcttataatatttgtgcaataggtttttttttttcttgatacaacctgttcagtggcttagaggcaaatactgtgtgatctcatttatttgcaagctttcctttttggagaataaatgatatatcagctcaagatcacacagctattttattttgagttgaaataaatcctaagatactaaatatgataggattagttaatcttttgcaacattttcagaacgttgatttttttccccctcaagttttatgtcatagtgataggagcatttcaaagaagaccagaaatggtttcaaatttttgtggcttgtaggaaatgtatgccccgaaaactctttataatacattcttgtgttggggggacaggatgtggggtgggggagagaatgagttaagggggataaattcagactcaataaatatttaaatgtttctggaaaagattcaactagattttaaagtaaatgttacatgtcagaaactaataaatgagatataagattaatgagtctttaattttatatgagatagatagtacaggtttacttactttcttttcttcatttcagaatattttcaaaattacaaggttatctttatttcaataagggtgtttacatttaaaagtctgtcacattgagaaacatgaaaatatacatagagctggattttaagagcagtgtaaatacctgcatcattggtgaaggcacaggggcttcacaagttgatcagccttgaggatgaaagtcagtttgaaaataagagagacatcagggagtaggaggtaggcacatagggaaattgttaggtttgcagacataacctacctgggaatgcagaaacttttactttatttttaaaaattttaattataaatacacaaatatggttgcatatatttatggcatacaaggtgatgttataatttatgaatataatgtggaataattaaatgattctaattagcatattcattacctcaaatagttatcatgttttgtgataaaaacatttgaaatttattctcctggttatatttaaatatacaataaattatttatgactatggtcacttcttgtgcaatatatttaaaaggaaaaaaaaaaaccgtatccctcctgtctaattgaggctttgtatcctttgaccttcatctttccatcaccccccaccacttccactcctactccccagcctctggtaaccaccattctaacctctgctactttgagttctattgttttagaatccatgtgtaaatgagatcatgtggtatttgtctttctgtacctggcttatttcacttagcataatgttctccaattcacgttgtcacaaatgaaggaatttctttataaaggctgaattagtattcagtcatgtgtacatatttcatgttgtttagccattcatctgttgatgtacacttaggttgatttcatgacttggttattataaatagtgccaccacaaacataggggtgcagtcatcatttgaccaactggtttcaaatattttggataaatactgaaaagtgggagtgctggatcatagagtaattctatttttagtattttgtggaacctacacacagttttccataattaatgtactgacttaaattcccgccaacagtgtacaagcaaaaccctctatgctaataaaaaatatagttcgtttcccattgaatgtgaaacttaaaacatgaatttgtaaaaaaaaaattatgtaaatacattttcaacaaaggaaaagaatacctttcctgatgaatgacataattaaataaatatgaaaggaaatattgttctaaaaactaattagggttaaatttaagaatttaaagaagaaaatattgaaaatttattaataaataggtgaaaggtctttctgctttgtatcttcatttttttcagttatgttatttagaagattaattatctgattaaagaactatgatcatttattgcatcatttttcataacttttattattagtgtagcatcaacatttacaatacaagtttcattgttcctttttaaacacgaagaaaacataataatgtgttaaataattttttaggtctaattgatctcttcctacatattcatttgctgtagttgtatctattgtatttatttgttattgaatcccagctgaagaatttcaaagttgttttatgtttaattcacttaataagcatttattgagtactgcatatattaggtcctggagggtggagattataggttaataaagcaaagtcactgccatataattagaaagaagactttttttgaagttttacatttatttatttatttatttttattctactttaagttctgggatacatgtacagaatgtgcaggtttgttacataggtatacatgtgccgtggttgtttgctgcaaccatcaacccacaatttctcctaatgctatccctcccctagccccctaccccccgccaggccctggtgtgtgatgttcccctccctctgtccatgtgttctcattgtttaactcccacttatgagtgagaacatgcggtgtttggttttctgtatctgtgttagtttggtgagaatgatggcttccagcttcatccatgtccctgcaaaaggcatgaactcatccttttttatggttgcatagtatttcatggtgtatgtgtgccacattttctttatccagtctatcactgatgggcatttgggttggttccaagtctttgctattgtgaatagtgctgcaatatacatacatgtgcatatatctttatagtggaatgatttataatcctttgggtgtatacccagtaatgggattgctgggtcaaatggtatttctggttgtagatccttgaggaattgccagactgtcttccacaatgtttgaactgatttacactcccaccaaaagtgtaaaagcattcctgtttctccacatcctctccaacatctgttgtttcttgactttttaatgatcaccactgagatgttagtttattatactctaagatctattgaggaaactgcagtgtgaatttctacaactgcacattgcacattcacatatcaccatagacaattacattttgggggaagaaattacatgtgaatgagcattttggagaaatatgatggtgaaaggagtattttagaagacgagattttacctaaattttcaataagtgttctaaactagatatcacattttttattagacaatattttgaaaagacccacctgctgaaaagaaagaacaaacatggttactgttataattattgattcagaggggatgttatgtatgtaggaaaatcacaggcaattcattaaaaaactcttttggtagcttctatcaccagcaaagaaaatagtttaatttcattttactgtagttcaaaatcctccccagggtgtaattctgattttttgtcacaggagccaattgtgttattagaataagaaaatggtgtattttaaaaaaatcagctacgttggctttttattctgatgataggaaattatgtgtgtgtgtgtatgtttcacacatgatggaaaaaaatgagtaagacataaatcttcagaattaaagcccggaagcaaagtgtatgttccagtgaagactttaagtgacagcgtgacgaacttttgatcagtgtttcttatcatggagtaatttcttgatcaattaacaatcaattagaatttcagacatggcttagatggcatgatcctatttcaaaaatgtaatgagccaaaaaaaatgggttggcagattccaaaatctatgaatatactgatttaagaacaggaaaaacattcaaatgtcatatttttgttagtacattggacccgtagggtatgggaaaaataatatactgggatatttgcagtcattccaaatatatatattatattatatattcatatacattatattattatatatttatatattatatataatatattaatatattatattatatatttatattatatacaatacatattatatattgtagtatagtatatattatatgatatattaatatatagtatatattaatatgttatatatatataatccaagttaaagcaatagaacaaaacacagtatgtggtacctgcagtgctcactgcaattgaacattcagtattaactcttaattcccttgaaataaaaccaaaatgggtcatatatagagatatatagttcttaagctgcctgagacaaaattccgaattatccacttattagttatttgcaaattattgactttattcttggctaaactttatccatgaaaagagaaaagaatattaccttaatcatgaggatattgtaagaattgcaggtaatactatatgtaagacccttaacactgatgtgcacagacaaaatgcttaatattaatgaatattagcagttaataatgttattaatattagtattatggtaaataaaattatggtaatttatgtgaggggattccttcttcctgcttctcctaccccagcaactaaatttaaataaagcatttatgataagggtaaaacggaaattagttaatatgatttttatttaagtgtggtttttgaaaaagacaaatgattgtattttacaaaactatgtttcttttatcaactctatacagaaactgagaccttagtcttaatgtataacttagaaaagagtttttcatgacaaagtgctgaaacaatatggtgtggacacctgatttcctggtaatctaatttaatacagtggtaaaacttggatgttggacacattatgctgtcccttccaatcactaggagtctgaagtagctggtgttgggttggactcacttccaagctgaatttttttgaataaagggccaatattgtttgatgactatggtaaggtctgtatgcttaaattgtcagacaataaacagtcagagttggcattctgttgtgaagatgtggaaatcaaaattggttcttgctatgatgtttaatctactttttcacatcagtgagtctccaaaatgcctctgggtatagctgacattttcctgcagaatgaactttaaatctttttaattacttgccacattacacgaatgagacaattttaacctaaagaaaatgtaagggcagatgttatcagttaatcattctaaccaaaaagaaaaaaatattcctctgagtcctatgggcaatgctcacatttcagtagaaatgtattcaagttgacctgccagaatgagttggttccttgcaataccaatagaaaatcaaatatagtaatcatttagaatgtacagaccaccaacatgcttaagaatgtccactaaatagcataattgctgcttttagttgtgttttaccagtgtatatatcatcacactagaaaaagctgttgattgtggtatttgttgtaatcaaaccaaatcaatttaacacatgtaccaattatttaaatataaacttaaaatttgagggtgcacatttagattatagtattagttatatatgtatatatttatttttacctagccttattgacctataattgacaaatgaaaattgtatatgtttatagtgcacaatgtaatgcatggatatatatatatatatatattttgaaatgattactacgatcaagctaattattgtatccattgcctcacacagttatcagtttttgtgtgtgataagatcatttaagttctactctctttgtaaatttcaagtatacaatacattattaagtatagtcaccatgctatatattagatctccagaatttgttcatcctgcctaactggaactttctaccctttgaccaactcttcccacttcccctatgccccagcccctggcatctgccgttctaagcggcaaatgaacttttataagttcaacttgtttagataccacgcatgaataagattatgcagcattgtcttactatgcctggcttatttcacttagcataatgtcttacaggttcattcatgttgtctcaaatggctgaattttcttcttttgtaaggctgaataatactaaattctgtacacatgcacatacacacacatgcatatcatattttctttatccattaatctattgatgtgcacttacattgattccatatcttgtcttgtgtcaataatggtgcaataaacactggggtgcaggtatccccttgatatactgattttacttacttactttagatgtatcctcagaagtgggattgctggattgtttttaatttgtgagaaacctccatactcttttccataatgtgtatactaatttacatttctaccaacagtgtacgagagttcccttctctccacatccttgccaacacttactttttgtctttttgataaaaaacatcaaaacgagtgtgaggtgatatctcattgtggttttaatgcatatttctctaatgattagtaatgttaagcatcttttaacatatctattggccatctgtatgtattcttttgagaaacatttattcaggtcctttgctcagtttttagttgggttatttgttttcttgctattggattgtttgagttccgtatgtattttggttattaactccttatcagatatatggtttgcaaatatttttgctcattctgtaggatgtctctttactctattgatttgttacctttgcagtgtggaagctattcagtttgatataatcccattcacctagttttgcttttattgcctttgttttggggttatattcaaataatcagaccaatatcaagaagcatttcccctatgttgtcttctagaatatttaaagttttaagtcttcctgttaagtttttaatcctttttcagttgatttttgtatatgatgtgatacaaaggtacaatttaattcttctggaagtggatatccagttttcccagtaccatttattaatgaaactgtcctatctccaccatgtatttgtggcatttttactgatgaacaattgaccataaaagtgatgacttatttttaggctctttattctgttttattggccagtatggtgattttctattttttttattgccaatatcacgacattttgattacggtacctttgtagtgtattttaaaataaggtactatgatgcctatggctgtgttcttttttcttaagatttgtttggctgtttgctgccgtttgtggttttatactacttttaggaattttcttcttgtttctgtgaaaaatgccattacaattttaatagggattttattgtttctgtagattgctttgggtagtgtaaacattttttgtttgtttgggtagtataaactttgggtagtataaacaatattaattcttctaatcaattaacatgggttatctttccattattttgtgttctttaaatttcttttattattgtgttttagtttttagtgtacagatctttcacctccttgattaaatatatttctaagcattttgttttatgctattataaatgaaattgttttcataatttttttagataatttactattacatgctactaattcatatatgttgattttgtcttctgcaaattgaatttatttattctcacagttttttttggtggaaattttaaggtgttctgtataatcatctaaaaacagaaaaaatttatttttttctcttcaagtgtcttttttttttcttgtaggcactatctagaactttcagtatagcattgcaatagaaggaaagagcattcttatcctatgtcctccatcttttctgggtatagtttttttggttgccagtttttttattgtaacacactgaatttatcgtctcatactctcctggagtgcatggttactgttgagaaattcactgatggttctaacagagtttctttcatatgtgataagttgcttttctcatgctgctttcgaaattctctttatctttgacttttgagaattttgttaccgtatgtcttgatgatgatctgtttatgtttaatctattttgggttttttgatcatcatggatctggatattcattttcctctccagatctggagatttttctgttattatttattcaaatatacttttatactttttctctttctctgctcattctaggagttctatagtgcatgcattgatgcatttaatgatatctcataaatcccataggctttctttactcttttttatcctttatttctttttcatctcataaatctcttatttatttatatctcataaatcccattgactttctttactcttttttatcctttactctttttatcttttatttctttactcttttttatcctttatttctttttattcttttggataatttcaaatgacctgtctttgaactcactagttcttgcttctacttgattgaatcttgcttctacttgactgagctatctgttggatttttcagtttaattattgtgttattcagctccagaatttttgtttggttcttttctatggattctatccctttcttaaaactctgatttcattgatacattgttttcttatttttggttagtcgtatgtctatgttctcttatagctcactgggcttctttaagacaattttgaattatttgccagacagtttgtagatcttcatttctttagggccagttaatggtgatttcttttattcctattatggtattgtgtttctttgattatttgtaatcctgtggacttgcattggtgtctgtggttttaaagaagtggacacctcttctagtctttgtaaactggcttcaccagggaatgtccttcatcagtcagcctttccagttattacgtgcagtttatctgatggggtctgtgtgtgccagcctggtgttgggacagggcctagagcctgagactgtggaagctggcctggtgctaaagtggaactgttatctgggtctatggagatgtcctgagtttgtgggaaccatcttgtgctgaggtcaactggggtaggtctggttattgggaccataaaggtgggtctggagtctggatctgtggggccagtcttgtgaagatctcctggggtaggcctgaaccctgggtccatggagccttggtccttggtagctggcctggaaccttggtctatagggactggcctgaagcatgggtccatgaggactaacctcacactgtgtcaggctttaagcctgattcgaaggggcttggcctgactctgagatgtacctggaaactggatccaaggaaacagatctgttcctgagtctgtgggagtcagcctgaaactgcagtttactagagtgggcctggagtctgggtctgccctggtaggcctgctacctgtatctttgtgggcaggcctggtgccagggaaccacaagggcaattctagatcctgggcccacagtggccagcctgatgctgggacaggtcttaagcttgagtgtgtaggagttggcctggggcttcagtctgcaagtgccagcctggagcctgaggccatgagggctgacctggcactggagtgtccttggaacctgggctcatgtgattgagtctggagacttggtctttaaggactggcctggcaccaagctaagcctagattctgagaccacggggccttgcctaacactgggacactgggatttggtgggatggggctggtgtcgaagtttgtggtaacatcaggtattcacttccctttcctttcctcgagcaggacacaactcttttcacactgtgctgttcaggcttgtgggaagggtttcatgaataatgtgaactgtccttgctactttttacaatgtgtcttttctcatatctgtgccccaccacttgctataatttgtcagctaaatttcttagcttttgtgaaggtatttttatccatagatagttgttcaaattaatgtttctgtaagggaatcagcactgcaaagtcttattctaccatcttgcagacatcaccagtatcatcatatatgacttaaaataaggattcaaagtcatttttaaaataaactattcctaccagaggagtcaaagtgttataacagatcagtgaaggctgagaaatgtgttatactttttctagttcagctcaactataaatagtagcaagtattggtaaagaatagattctagctctggaaccagacagagaaggagatggacatgagtctcagctttaatatttacttgctgtgcacttcgaacaagttattcaatgtagataaacttcagtttcctctaataataatatgagggataataatgtaacagtgtttcaaaatgcaatcagaaatgttataatatttctgaaagttctgtttgaagtcttctcactttgggagatgaaagaaaccagtttgaggtgtttcatgagggtttttcatagagaatatgaaaagtggttaaagttgtcttacttgaataatatgtggaactcacacttagtattagttcagacactgaaaatgatttgccctaaaatatttaccaaatctgagattttttttcactactgatactgagtcaaatttaaaggcttgaatttctaatgatatgtaaactttgttttcctatatagttaagttataacctttctgaatagatcttagggtaaaaagctttcactgtaaaaataagccctaatttcagctatcataatttgggactaatgcagagctagccctgctctgaaggattggatacgaatgtgttttactccttgaattcttcatcttatccgagattctaccagtgaatcagtgacaactttgaaatctagagtttctgaatgagtttaatcctctcctgtttcttaggcaaaaatagttcaaaacatttttttcatagatctgagtatcctgtatttatattatggatgtgagataggagcaggtttttaaaatctggcctacaggtaatgaaataatgcatatgttatgtacgcaggccaatttaaataagctattcttttttaacatacaatctcatattcatttctatatgccatttcataaaatatgccttttttattgacttctttgggcaggaattgtatgtgtaaaacaaatatggaaatcaaggacagctgtacaataaatcaaagtcacaatgctgaaagcagaaacttgagacgctcctttaaaaaaatgacttgtaaatcaactcatggttgcctgacatttccactgattaatgccggtgtcctttgaggcatactaataggataaacaaggaaaaatggaatttcttgccataagatgagggtcagtttgaagatattcatgactcagtcgcatcacttaatcacaaatagttgtaacctgtagcagaaattaattcaatgtgaattttttacaattaaacacagtagtctttgtattgctgcacataattaaccttcattgtctcaaatttttcaaaataaaacatttctacttttaattacaaacatctaatttttgtgagttataacaaaatggaatattttctgagtaggctatagagtaaatttagttctgaaagttcctggaataatgtcattgagaaacataatatagcatcagccataaaatgtcatggttgatgctcactgaaagccattcaaaggaattctgtattaacttttgcaaatgcacactttgaattcataaatctttatgggaacacattttaacaaatgtactgtggtttatatttaaaagcactatgtggtttatagttaaaagcaattatgattcactctgtctgctgaactcactaaagggaaggtcttcactgaacacaagactcttaagaacagtaaagattgttgttaaaattcagagtatcagcctccttccaaactgggccagggacctcctttaataagaccagcttcagtgaatatatattaagagatatcaggagctaaagtaagttaatagaaaagaaaacatcaaaagagtacattctaaagaatttatggtatatatacacaatagaatactattcacccatagaaaatgaaatcctgctatttgtaacaacatggattatgttattatgacaagtgaaataagccagacacagaaagacagacactgcataatccccacatgtcctgggaggcattcagtggaaggtaactgaaccatagagatggttacccccatgctgttgttttcctggtagtgagttctcatgagatctgatggttttataaagggcttttccctctttgctcaacacttcttcctgccatcatgtgaagaaggatgtgtttgcttcccctttcgccatgattgtaagtttcctgaggccttcccagccctgtggaacagtgagtcaattaatcatctttcctttataaattacccagtcttggacatttctttatagcagcatgagaacggactaatacagtaaattggtatcacagaaagtggggtgctgctgcaaagatacccaaaaatgtagaagaactttggaactgggtaacaggcagaggttggaactgtttgtggtgggggcttacaagaagataagaaaatatgggaaagtttgggacttcctagagacttgccaaatcactttgaccaaaatgctgatagcgacatggacaatgaagtccaggttgaggtggtctcagatggagatgaggaactttttgggaactggagtaaaaatgactcttgctatgcaaagagactggtgacattttgccccttccctagagatctgaggaactttgaacttcagttagatgacttagggtatctggcagaagaaatttctatgtggcaaaatattcaagaagaagcagagaataaaagtttggaaaatttacagcctgacagtgcgatagaaaagaaaaccccattttctggagagaaattcaagcaggctgcagaaatttgcataagtaacaaggagccgaatgttaatcagcaagacaatggggaaaatatttccaggtcatgtcagagaccttcacagtagccccatccatcacaggccgggtagcctatgagggaaaaatggtttcctgtgctggacctaggggccccctgctctctgcagttgggacatggtgtcctgtgtcccagctgattcagctccagccagggctaaaaggaacaaaggtacatctcaggccattgcttcagagggtgcaagccccaagccttggcagcttccaggaggtgttgggcatctgtgggtgcacagaagacaagaattgatgtttgggaacctccacctagatttcagacgacgtatggaaatgcctggatgtccaggcagaagtctgctgcaggggcggaaccctcatagaaaacctttactagggcagtgtggaggggaaatgtggggttagatcccacacagggtccccactgggcactgcctagtagagctgttagaaaaggaccaccattctccagaccccagaatgttagatccactgacagcttgcaccatgtacctggaaaatccacagacactcaatgtcagtcatgaaggcagcctggagggggaccatgtcctgcaaagccacaggggtggagcttctcaaggtggtgggagcccaacacttgcatcagcatgacttggatgtgagacatggagtccaaggagatcattttggaacttttagttttaatgattgctctattggatttcagacttgcattgagcctgtagctcctttattttggccatttcgtctcatttggaactggtgtatttacccaatccctgtacccccaatgtatctaggaagtaactcctttgcttttgatttcataggctcttaggtggaagggacttgccttgtctcagatgagactttggacttggacttttgggttaatgctggaattagctaagacattgtgggaatgttggaaagggcacaattatcttttgaaatgtgaggagatgagatttcagagggactggaggtggaatgatatggtttcgctctgtgtccccacccaaatctcatcttgaattgtagttcccataatccccaggtttcatgggatggaccccatgggaggtaattgaatcatggagacgttacccccatgctattcccgtgataagtgagtgagttctcccgagatctgattttacaaggggctttttcctttttgcttggcacttctccttcctgccatcatgtgaagaagggtgttttttttcctcttttcaccatgattgtaagtttactgaggcctccccagccaagcagaagtgtgggtaagttaatcctctttcctttataaattacccagtctcaagcagttctttatagcagcatcagaatggactaatacacctctgaaaaaagttgtgtaaaatagaatgctgctgtatttattacaggagaaatagaatgtcaaagacatgggaccatttgtgtcttttgataagtttattctttctgtatttcaaaatgtcacaaataaatgaaattataaacaaaaaagtttgtaacttaaagtctgaacaaaagggttttgatggactaaataaaggcctctcttctctcattgtctgaaatgctgtctaggtagctggacattattatggttagttatctaaccaaatatacctccttaaaacattcaggcttgttaaaaacataaatgttattgttattgccagggatttagaagatatgtttctgatcttgaaaattttgattttgattttccttttttttccaattcaaaaaaaggaagcggaaagtttgagatagttactcatatagtttctggtcccctaaacattgttggagataccctattacttatcatttttttttagaatccctagagagtgattctgatgcaagtatacccataaatagaatataatcaattatatcactggtgcagtccagttattatgatcaattattatttatttcttgtaatcattccttatttattttaatagctttctataaccttaccttcataacttaaataacttaaattttgacgtttgcttgcaatcatctattttctggctattccttagggcagataattttcataaatagctgaatttatcctttgagggttttaaaattatgttaaatttccatgtttatctgcaagttatggattatgtcactttaccatatcactcctttctgctgacaagcattaacatctatgggtgattttgtaacaacagcaaacatcgtcattgtagtattctctgccttggactttgtaaagttaaggaagtgatgtagtaatatttactagttgtgtgattttgaatgttaattattattaacattggatattaatttatccaaactcaaatttctttcaccagattatagggaaacttacaattgcctagttgattttccatatgaattagggataatgtgtattaaattaccaaaaataatgattggcatttgttacatattatcaactgaagagtgaaatttggaaaggagcgctttattactcataaaatattgcagccttcagggttgccattctgactggctgggaagcatagcctccagccagaagtcagaaacagatacttcaagggtgggaagaataagatagtaatttatgctgaatgaggtagccaaatataaatgttcaataagctatgggaggagtcgtaaatgttcacaaatggagaaacatgcacatgtgcaattgagcttcatgcctctccacaggacccatgttcaaaaaatggtgacaacagcatgaactcagggcactctctgatgttaaaaagtgaagcagaaggcatgaacaccctcactgcactgtgcattctctctagactgtctagaaccactccgtgatcagtggtctcttaggcaaaaaaggaagggcagcatcaggcgattggttgatctcagtggctaaatccttttttttttttccccctttggatatagagccttttggtttgttttctttttcctttcttttctttttattaatttccataggttatttgggaacaggtggtgttttcttacatgagtaagttctttagtggtgattttggtgcacacatcacctgagaagcatacactgcacactattcgtagtcttttatcccttaccccttcccatcctttccccctgagttcccaaagtccattgtgtcattcttatgcctttgcatcctcatagcttagcccccgcttattagtgagaacatatgatgttcacaaacacacacacacacacacacacaatggaatactactcagctgtaaaaaggaatgaattaatggcatttgcagcaacctgaatgagataagagattattattctaagtgaagtaacgaaggaatgaagtcttttttaaaaggactggtttctgtttaaccttcagggaagaaagcctaatagctgttagccacctgggaggggatataatgaggggtctgtaacctcctatctagtcctgacaggcaactcagctttcatggtctctttgtagcccagttggccaagagatggtctgttcagttggttgggatgcttagaattttatttttatttatcaatattatgattgttgcaatgaatgataatatattatcattaaaaataataaaaagcccttaattcagttaccttaattaggtaatttaattagaaatactcctgctagtattttgaaagatggtcttgaaacacagaagaaattatgtaaagattatagagactgtttatataattttttgatttaaaaaactcatttcaattaattggttttagtacaggtctcgtcattccttaagtactgctcttaattatttccttacttggattggctagtggtttttctcttcttatgaattttatgaaataaaccaaggtcaagtttaaggtagaaaaagatgcttttagagaaggcaaagtagggtcttaaatatggaatttgtatgacaacttatcttgccctttgcttctgtttcaggggtatacttcttataaaatatttgctgacaaggaagaaacacaatttcaggttcttgtaaatagccaagagtatttgtagtcagttttcccaaacgcatttgctttgtattgtacaaagtcgctattgtctatcattaacatatcattaacaatcatattatgtgaacacttaataattatgtaccttcatgctgagactccttgacttaccatatgtacaatgaaaatgttgaatcagcttttttagtacaaggtcattgacaggccatgtgggagacactgactgataagaatggaatcttctcactcagcccaatgctccaccaaagggagattttcagtttgcttcttattagcacgattcacaactgagaagtgtgaatgatcttatggttcacttctctgatgtgttggagttggcctgcatgggtttgcaaaagctggctcttaaaattttagaaaacttgccagctggtttttgaatacttggtagcttgaaattggttataatgtgaatacttacaccacagaaactggaaaatgcctctgcccttctattccccaaagatcttattgttaaacatttattagcacatctggtttacttccacaactttagtactcagctattaccggaaaagtccctgatgaatgtatttgttctttactatgaagtttcaagtgacagaaattaaaaaaaaaaatactgcagaaactacactgctctgggtataacttcctttgaacagttaaaaatttcccacagtctggccaggcatggtggctcaggcctgtaatcccagcactttgggaggccaaggtgggcatataatgtaaagtcagaggttcaagacaagcctggccaacatggtgaaacttcatctctactaaaaatacaaaaattagccatgcatggtggcatgtgcctgtagtcccagctactcgggaggttgaggcaggagaatcacttgaacccacgaggtggaggttgcagtgagctgagatcatgccactgcactccagactggatggcagagtaaaactctgtctcaaaacaaaaacgaaaacaaaaaatttctcactagtctaagtagatggaaaaagaaatagtttttttccaattatgagtttaccacaatttggctcttctaggtccaaagtactaacgctttctatttaaaatcgtatttcggaagataaagttttaaaaaaattttaaaggcaatgacaaaaaaaaagattttagtattattaccaagtgacctagatataaaattttatccattaatgcagcatcatgaacttcctataatttcctttctggtctcagatgaagggattatgggttattgccacctaagaaagcatgggatcagagtcttaaaataaatcaatattcatgtggtctaaaatgattcctcctgtaataaagtcgtaccattttcaatcaaaaatataattcaaacggggaattggcaaaattccaatgcttgctgtatggttagtggttttacaattaattccttgtatcatagtgcgtgatccttggattaatgtccctgatggttagtcattttgttaattcacctgtccatcaggactcaattgtgataccttattcttccttcagatggtttaaattttacaagagaatacaattctcatcttctaaaggtgcattagatatcgtcatctaccagggtcttatttattgaaagaccttccaagaaaataggaaattttcttcctctttctgctttttcaaaacagttcattttcatatatcaaaaccggctcattataacaagtgaaatgatagagatgaacagagaaaaagctaataattcccacctaagtccctcttaatgattacctttctgtcataacaactttttatatacatatattatttcatatcattttccaagttatagccaaacaaatggatataactcattatcattttgttgaggttttattaaggtagaagcacaaaataaacctcgttttatgagtttgtttcttttttttaacataaaatgtattatggatatcactcctgggcaatagatactgatcctactcattcttaatggctacacaatgttccataatatagatgtatcaatgttttcaactattcatttatttataaaccttcagattactttttcattttatctcttctacaagaaatgctgtgttaaagatccttgcctgtgtgtaggtgtgtgtgcatgtatacagttatttcagtaaaaaaaaaattccagaagagttactactataaatttttaagtaggtattaccaaattgtttttcaaataattgtatcagttgatagtctcacaagtaaacttttaggaaccatttactttcaatggccaaaagaaattgatactattaccaagtgatttaaatgtagaatttcaaccattaatacggaattattaaaaggatatgagaatgaatttctccacatgttatcaagtgctggattttattgttcctgttcatttttactggattcaaaagcccaaagtttgctattttaccattcaagcttctgagtccagcaaataccaattttaatatatgccaatctgataagaaaaacatgatcttcatgtccactagtgagatttaacatcttttcatatactaagagtctattttgaattttattttgtcaattatgtttcagttaattccctttaatcttttaatttttgagttttatttcatcttataaatttatgagtttcctttgtttatcaaatatattaacaatttgcagtatagtgtcatggttacaagcacagactggtgtcagactacctgccttcaaatcctgtcttccacatctcttaccagtgtgtctttagggaagtgtcttgtcttccctgttgtccagtttcttcatttataaaatggaaagaataccaagacctccctcactgggctgttttgaggaagaagtgttagctattaatatatacacattttccccttgtgattttgtttgtctttgaactttgggatatctttcattttaccaacttaaaggtttttttgttgttaaatatgtctaatttgttttatggattatgcattttctttcatttaaagatctctcccactcctaactcttttattgttcaggtattaactttattttttattttttatttttttgagacaaggtctcagtccgtcaccaaggctggaatgcagtggtgtgattatgactcactgcagcctccagctcctgggctcaagtgatcctgccacatcagcctcctgagtagctgggactacaggtgtgtgccaccattcccagctaatattttttaattgtttaccatcagttttataatttttctgtgtatttcctaagtttctaaataactagtaaattacaggataaccaaagctatgctcagtgattgctggtgctagattgcatatatgaaatagctgtaaaacaagaagtaattaaaatagtaaataattttcattattatagattttgaaactaaggcaaaattgctacattgaacattacaatttaaaagtacacatcaaagaagcatttattattttatttatttgaggtcattttcaccaaactagcaacttcatgggtacaaaaacattgaatggcatatagtttctgattttgtgtccctggttaatgacaggaagcacagaactcaaacctcgtacacaaggaacccatcttactatggctttcctatccaagcattgcctcaacaaaacgtactcacatttagcccaattcattctttttcaggcatgtggaataatgatattcagattttctatgaaaactgatatttcccacactcacttctttgcactgcagtttaagagtgtatgaacactacttaccctttggtcatccatgtttgaaagacatatttgggctttcacatttttctgtcacctagttagtgtaaaacttgtctgtattcctccagcttaattaagatcaactgtgcttaacaaagtcattgatttcttctttaacattaaatcgtattccaaaagaatcgccaacttctcttgatacatacaatttaattcaggtataattataacagttttatggtatattgtttttataaaattaaatagaatgtttcttacagaattttgtaaaagacgttctggttgtgatttctatagtaaagctgtcagaaagctggtctgtcgaatgaataagtgacattactgtagtcaaaactacacttttattgcttttacctccttgttgtatttatagtacctagtcataatttctaatttgacagacacttgagtcttgttgctgtactcagtggtgtttcttgtcactctctctttacctcaggtgctttcatttctgcatttgactccagtatctagaaaatcatacataatggcaatttacactgaataataaagtagacttgtgtgaattttttcttgagctattcattttgaacttcaagtcaatattaataatatcaacattaaaagtaaactaatttgcaactgaactttgcagcagggatcaaggaagagttttgcataaatgttactatattatttttcagtatcataaatttttgattgtttttggctatagtcatagtttttcctgtttcagatgatcacttttgatttccttcctcttctcttttcttccttccttcattttttccttcaatcgcttttcttctttgcatttcttgctctctctttctctctctctctctggtttaatataattgattgtatactcttatgcactcagaaaaaagtcttaaaacctcttatctgaactgatactttgtattgaagagagtaatatgaaaattgtaggcagaaattgaagatcttacctaattggatgttgaatgttggtcctcccttgtctcagatggggagaatataggtaacaggttttgtctatgttgaagtgttatttgtcactcactattcaattacagtactcatatatggctttaacctcttttaacctgcacaattacattttcacaactatagctatggtgccacttaaaatgtggttatttgtcttaaaattgttcaccaaatttcatgtggaattctaagcctgatctccttggagatttgagtcatttgataggtagaagttcataagtagttagcctggttctctcctgctgtgttcttctcttctctggcatttgccctgtattttaggaaattaattgctgtcttatatgtgcctattatacaagaataaaataattctcatatattcatatatacttatatataatataaatatatattattactaatatatatttatatattatttgaaaccttatatattcttactatatatgaataaaacactttctggagagaaaaaaaacagacatcagagtcgtgcctgggatagcctatttgataaatatttgttgcattatttcctacatgaatgatggcacaatacattttcttttaaagattagcatttcagagagatgctcagaccataccacttctaaggaaatgattgtggcttagaaaggaaggaaagaggaacaagaagtagtaaaggatggttaagcactgagtaagcttttttttcatttttgttatctggcataaagcattaggaaaaaacaactctatttttccagatgtcccagtctttcaactgacatatttacagctagagcacgcttattcatttatttatttatttttggagtggaggaagaggaggtagtcaggtggtttacaaaaggtggatttctaagtctctgtcaacatagaccaaccctgctggacctcatactttttccccttcctccctgtcatcctcatttttttcctttctttaaaactacattttgaatgtctacttgaatacctgttcaaggcattgatacttatcagtaaatacaatggccaagaactttgctaccatgtagtcattaccttctacaacaggaagaaaactaaaataaagcaaacactcaaataccaaaatttaagatagtaataattactattataaacagagtaatgagttaaagagtgatggggtgaaagtgatgttaagtgttgacttagattgactggctatggaagaccttcttgaaaaggttaattttgagggatgacttgaccaagaaagttcggttatggggaaatctgtggcagagggaagaatccttctgaggaaaggctgagtacaaagaggaggcttatgtgactggaacttggaaagtgaagacaagaatggtggaaagtgaagacaagaatggtagaaagtgaaggtccaggttttctaaaccttgaagactcctgtaagttcaatgagaagccaaagggctgttataatagcaaaacgctaagatctgatttgtagtttggatgctatatggaaaaggggttaggtataggttaaaagaatgagcaccgggattggggtgattaggtccatcagtaatatttgtgggcctagcgcaagaggaaaaatggagggaaataaatgggatggaaggttaatcacatgtcacaacaaggttggatcttaccagttttgtctaattcctgatatcaacttcacctctaagcagttagaagtgggggaaagactgcccacccgcttcctttgtccagtgaaaagtctcacacatgcgagtgaacactgtagctatttaggcaggaaattccatggtcctttgcatttggaaaatatggcagccagggaaaccttccccttattgctctggaggtttgctgcaaaaaatcaatcagaaaaaggtgaggggtagagctgcacaggaacaagtgtataattatgcagattcatttcctcaagtaatttcttggcgctgctcttagaagaatagatgaaagctctgtctggatgtggtgataactccaagtctcttctcaggtggttgatttttcctggttatttgatgagatcacttagggtgaggatttaagacaattgtatttcttttggaaagaagctttcttggtcagatgaggaaattccaaagagactctctccctgtaattggaagtggagatgcaagacaaggttagaggagcattgattctgagtcatcttcaaaagcctctcagtatatcagagtgccagtctttgggatattgctttttgagtcccaacaaaagggatggataagtgggtttgtgaactttcaaggatgtaaacacttggtctcaaagattccttgtcctgtagcataggataaatgtagaggtgggcaaaattgggcccagtaaagcctgaagcccaggggcacataccctggttgctgagctctaagggaagtgtcattactgataacattaaacatagagaaaagtagagaggtgctatgtatgtttagaagtaaaatcaaccaagttgaaaacggggtttgaggaaaatagacagtatgtgtcttcttagagcttatgatgtagcaaggaaaggagacgtaaggtcaggggaagacctgttaaaattgaatacagcaaagaaaatccctcctgcctccagtcctagatgcctttttcttgcagtatttttgatatgacactgaaataggactaaacttctgtaggaaaagcataataccaaccaaatctcaaatagtcaacataatacttttccagaaaataaatgggatcgaaggttaataacctgtcacaacaaggttggatcttaccagttttgcctaattcctgaaatcaccacatacctctaagcagataggagtgggggaaacactataacaagaataggttcattgcctgatgcacacagcaagtcaatacactaagactctgggttgcaacagaggaagaggtttagtcatcgtgtcactgaatgaagagatgggaagaaacctcaaatctatcttccaggggaatttggggttagggttttaaaggttttggagtgggctaaagtgtgaagatcgttgattggtcaaagagtgcagggagaagtcatgggacagggagaggaagaagctgtattttcatgctggtcccatttctctgagggggtcctccaacttgttgctggaatttggagtccaaaaaacatcttaagcgatagattcttaaacaaaagctttatgattgtaaagtcagagatcctgtctataggaacaatggggatgaaagtcaattcttaaacagtcttatgaccccagtgtcaggaatcctgtctgtaggaacagtggggatacaaatggtcagtaaccaatgctaacatgactttcagcgccaagaaaataggtcaaaatgcagccggattgatgcttaactataactatatttctgtccagaaagtggcatgcaattcttatcaaccctggggagggggcagtttcaagactaaagagatagggaggccaaaaacagtttgctcagaccatccaatgactggagctcagagtgagggctacagttccttgaaggactaggaaagcaaggaaaaaccctcttcatttatttaaaaactcattaattaattaattaaaactataccattcgaagtcactgctgggcacagagaagtgttagtggaatttacattgtttctgactttatcgatgtccagtgtaataaaggcattcagtgggggtgtgagggatgaagagaggtgaggctgagtagaggcagaaaggagcccagtggcaaatggccaatgaaggaagcaggccactgtggagtggggttagagtagaagcaagtgatgtgatgtgttttattattctgtactattaaatttttggtctaaatctccttgatttcctccccagatcaagaagttgatttcctgtctttgaggagcttggtcaagggatcctaatttcaaacattatgaaatgcaggggtggacaaagaagtacatcattattacaaaaactaatctagaaaatgacacagattaagtgtgcaagtaaagagaacaactgaggcatttatcaatattctatcccagaaaaagagaaacgttccagagtctcttgggggaggtcaattctcaggccagtggtttaataatacaaaacaacattaacatagcagcccatttcattaactttgattacactcctctggatgcttacttgcccttagtgactgttagtaagatgttttccctatatttattaggaaagcaacctttatgttaaagatctgcaaataaaataatgtgttgaaatatggggatattttgaaactgcttaggtatggtgaaagttaatgatttcagttacatctttataattactgtcatcaggtttctacctttatggcttcttaattgtttaaagatcataaaacagaaaatttagcacaagcttgagaaagatattttatggtataacataattttatattgatattatcactataaaaagattaacaatggattttactttctacacctttgattattattttaactataatatactatgtagtctgtagcataacattcctactaaacaaacactctgtttttatttagaaacaagcattttttaaggttttaacttttaccaggcttaccctgttgatgcaaaataaggaatggggggtctggtagtacatgaagggaaaaagacagggtgacacttcccactggggaaagtcaaatttacccctcagaaatgtggcagtgaagggttttgtttgtttgtttgtttgtttttagatagggtttcactcttgtccatctggagtgcagtggtacaatttcagctcaccgcaaccttgacctcccaggctcaggtgatcctcccacctcagcctccagagtagctaggactacaggcctgtgccaccatatccagctaatctttgcattttttttggagacaggctttcgccatgttgcccaggctggtctctaactcctgcgttcaagtgatcttcgaagtttggcctcctaaagtgctaggatttacaggtgtgagccatcatgcccagctggaatggttcctttcaggctaaataattctcttttggtcaaattcatttgcttcattctagtgtattgagactgtactcatgaaaccagatggctatcataatcccaaaaaacaaaatcctaaatataaatatcgaaatcctgaaacccaaattctggggaaggtattattgcattttcagttgtatgcaggatggttgcttcatgttagtttcatcacattaagtgaaattattactttgtgcattagtctgttctttcattgcaataaagaaatacctgaggctgggtaatatataaagaaaagagatttaattggctcacattctgcaggctgtacaggaagtgtggcgtgggcctctacttctggtgaaggcctcaggaagcttacaataatggtgggaggcaaaaggatagtaggcgtgtcacatggcaagagtagaagccagagagagaaaaggaggagatcttagactcttaaacaaccagatcctaagtgaactgagcaagaactcactcatcaccaaggggactgcactaagccattcatgagggattcaccatgatccagtacctcccaccaggccccatctccaggaccaaagatcacatttcaacatgagatttagaaggggcacacatccagaccatatcactttgttattgtttttatttggaaataaaatatagtttaaagacatatgtatgcataccaagttgacaagggctattctgacttgtgggacttaattttggatgtcaacttgagtggattaaggaatacctaaaaacctggtaaagcattattttgggtgtgtctgtgagggtgtttctagaggatattagtgtgtgaggttgagcagactagatgggacatgctgtcagtgttggagagcaccatctaattggctgggcctggagagaatgaatacagaaggtgaattgtctttctttgagacattcttctgctgccttggaaattagagctctggactgactcactaggctttggactccaggacttacaccagtggtaacctgggtcctcaggctttcagagccctctgactgagagttacaccattggcttccctggttctgaggccttgggacttggactgagccatactatcggcatcccagggtctccagcttgcagatagcctgtcatgggacttctcagccaccataattgcataagtcaattctgctaataagtccactatatctatatacatgtcatattggttctgtctctctgaagagccctaattcagatttggtactgggaaagctgaatatcatttcttcttactgtattccttacaacataatggaagagagctgtgaaattgttctcttgcaaaaaggctgtgataagtgaaggagtctacttaatggtaaagataaaagcttaaaagtgaattattattggtgctatgaaagcagaaaatcacttaattgaaatggcagagcaataaccagactgtcaagtggacagcatctacttacaaaatttgtcgatcacaaccactctgctaatctatatgccgtggtttaaagatcacagaagaggagaaaatgcaggtgaaaaaatacaagaaatctcccctgccaagttatttaatcatatattaattctactcctccacacataatgccaatttgatgtgctatgtatttcatctttgcatcatttccagtactgagatatatattgtacgaagatttttagagttttaatttatcttatacatttttgcgaaattgactccacaaaagtgagttaacacaatgttgacttcgtgtgtaagcactgtgcatgtacataaaaaacactgaaacttaataaatgaaaagatgtcttttttgtacatcggcatttgtgaaatacatttcttgatatcctggctttattggcaactgcatatggagtggtgacacaataaagtttttggtcaatgtcatcaagattttggttgtctgtcctggtatttcagatgaacacagttataaagctgggtgcacacaattaccaaccgtagtaatatgtatttatacatttcactttttaacttttttatcactatggtttgtctgctcgtaactgttatacccttatgactgttgttagtatacctgaatgtttatgcttgcaaaatatgtatgttattattgcctattttatggttaatgtagcctataaagtgttctgttgtgtttgcatattattctcaaatatctccctttaaaaatgtaaatatgtgtctttcaaataattttttaaaaatgtccagaattatatttttgaaattttgatcttttgggacttcagcatttgggattatggtgtttggaattatatcttttgtgactctggcccaaaccccatgaaaatgtgtgtgtgtgtgtgtggtgtattcatatcagggaaacgacacactagaaagtgtgaatttaagcttatgttcaaaatttcaactaccacctacgcattttataactctgaaatgtttatattcaaaacagtccatgccctctcctgagacccacacatatttcctagaggcagcactattgtggataagagcagggattttgaagtaagatagttctaaccgtgtcatatcccagctgtgtaaccttgtgtgagttactcacctctttgtgcttcactcagtttcatttcataagttttataaaaattaagagagttaatatatataaaatgctcacatcagtgtctggtaatagtgctatataaatgatcacatttatcattattaatatcatatcttactgtctattgcacatctccatcatcaggatgtctcacaaacaacgaaacttagtgtgttctcaaattaactttatcttctcgtctctacctctctcccaatcacctcctcttctgtatactatatgtatactcttggccaagtcagttatcttggtttccttcaaacattcatcactcccaattcctagggggtcagttattcttcatatactcatcaaaagcacttgtcttcccagctgctagtgctcgaggcagactggataccgtatccaggaggcatcatcatgatatcttcctgatgaccactacttccagaaagaaggcccttctcatctaccctttactctgtcaataggaagtctttcttaaatagtaaacagaaatatacaatcctgccactcacatacttagaaatcattctgtggatctccattctttacagaacatttgaacttcgtgacatggaatacaaggcactcatagtcacccctgtaattacttcatcagcagcctcttgcttttgctcccatctccagctggaccttgttaactcccttcacaccccatttttaccactcccaaacccttgccctaagcaatattgacctgacttctacccagcctccacctcaaaaagagttagcactcctctctgcgttttcttggcagtctctccaaaatgacttttgtcatattattttgttatttttatttatatattgatatttttttctcattttgactattagctctttgaaggcaagactataccgtattatttttgtttcctgatacttaaagtagagcctgctatacagtaggtgttcagttaatatcttttcaattagtgaagaaagtagtctgaggtaagtcagggaattgactgctgacgactaacacatcatcacctgcccattatttcctattgagtggacccagtcaactcatgcttttattttccagattcattgaggcgagtataatcaattcaaagtgacaggtaattcctacatacttatttatatttgtatgcttttttcctaccttctgatattttaaggatccacttatgaaataataaatttacattatcagaagaaacttgctatgaatagaagcttaatagtggattaaaggcagagttgttctgaaattttactttgcccttattagcttttgaccttaggataggtgtaccttctaagatacatctgaaaatttgacataatagtaatactttatttcatgattgttgtaagaagtaggataatgtatttgcagtacttagtacaatgttagacatgaaagtaagtatattgtaagtattagcaatcgttattatttgttcaactatagtagaagtatcctccccaattagaaagaaatgatacaaaattgctggtcaaactaagctatatatttttttctttatcatcatgaaaatggttaaatttggggcattttgaggacctattgcatgtctgatgctgtgcaagacttggaaaacatatagctatttacttatgagaataaattctttagtcaattagctcatagtctatggtttcaaaaatgttcatctttagaatacatattagaagcaaaagaaaataggaacctagctcaaatgtaaatcaaactgatgtatcagtagaacaaatcaccaatcaacagatacctgttgggtatcatgctatgcagaactcacaggaagaagtttcatgccattcagttaattattagagagagaaactggtagtaatcaaggtgggaaactgggggaagcaaatatagaccaccttgtgctttatgatgtaaaggaaatgagaatgtagaatagcttcatgtgaagaaagaggaagaccatcacaatgtttaaaatattttctttgttttcaaattatttaactaaaattgtctgcatcagtggaggaagtccccaatatttaattcagtcacccattcatttgttcattcattcagtaaacacgtactaagtatctaggcaagtagaatacactgaatcacaattgggtgaatgaatgcgtcaatagctaggactgtcctcggtgttggttacagccagtggagaaatcagacaaagtgccctcagaaaaaaatatattttcaaattagtagtattgtgtgttactctcaataaactatcaactaagatttattgggtagtttagagttggtggttgtgtcagtgaagcaggttgggttctcgaggaagcagactctgagacagagtttagcgttcagaatatttattagagaaggagctgaagcaggattgggcagagggagaggtcaagatgcactgcagcattggcagaccctccgtggagctctggacgtttaatggttacccagagttgtcctaccttgggtccaaatgactgggcttttataagagtgcctgattcagccactggatattgtctgctccagaagaacataactttgagtgaagctgttctctctcctggaaacaatcccttaagggcaaatagctgactatccactgacagccctccctgaagctggggcagcaagtccttccttgacaaggaagctgctcggtataacccgtgtctaccatagtcgctttaggtttcaggagcaataacctaagaacaactcaaattggcttatataataattagctcacataactgaaaagttgagaactaagtaaactttaaatgtggtttagattagagctcacatcttgaggtttatttcttggttgatggattgattgttcctttatgaaagtctggtcatacaaccatggaacaaaaatcctgatcctttccccctttttaagatttctaacccctaaggttcccttctggtggggcatgtcatgtgcacagtaagatatttgacagaattcctgttctccacccagtaggtgcctatagcaaactggaggcttccttgtaattatctctcatcctccctgaatgttggtggtaaatattcttaacttcagtggaaggtggtcacatcataagtgccagaagcagaattcgattgtctggtggacacccatgctgattacctgttctctgcatcacactagcttcacttaagagtcatcgagaaaggcaagaatcaggctgggcacagattttcatgattgtctccagaacagaattaaggagaaggctagaagggaaattgccttggtgccagaccacaaaagccactaaaatatcactggaaacagtttggaggaaaaaaatcactagaattcctctcagggaagggtactgcttgtggtcagaagaaatacttccatgagccacctgtcaagagaaagaaccctccgataggagcttgccagagcagcccctctaggtcatgtgagcaagtaaactacagagcatgagtttggatgaatgaggcctccactgtgagctagaactaaatcattcagtggtattaccactggctgcctttcttctcagccctgaaggcagcctgttggtgccagcattgagctttcttcttaaacatatgtcaaacaggtgtgttgattggagtcccatgttaccagctgggccaaagtaattctcaccctatctctcagcccatagggcttctgcatggatgcatcgtatgtatttttttttctttttgtattctgatgatgcaataaagcttaggcttcagaacccctcaccagtatgggacccctttaaaaccttgaaaggggcccagcaatttatacacatgtgtattaattagtcttttcttattgctgtaacaaattcccacaacacacagtgggttaaaacaccaatttattctcttatagatctggaggtcagaagtctaaaaccaaagtgttggcaggcctgtgtttcttctaaaggcttctggtggggttggggaggggtttttgtttccttgctttttccagcttctagaggctggctgcctgcattcccagggttgtaactccttcttcacatcatctcaaccttttacttccatcttcggatcctcttttgtccctccgatctcctgcctccctttataaagactcttacaacttccttatgcccatctcctgataacccaggataatcttcccatttctaagtgcttaatttaatcacatctgcagtcttctgttgtagatagtgacttgtaaattttgaggattagaaagtagacatcttggggaaccattattctgcccaccacaacacaatcatatgtttaagtacaatttgtagaagacattgcatacacactcagttaaaatggccatccctaataacttctgatgtcacactttacctaaggtttggtagtgttggatagtttcaagcattcagggttctaaggagaatttggtttgagaacacatttggtttgttttcatgggacatattgatcacagtcacagcgtgtatttttaaggtgttgctggctagctggtgtagtaatggcttcccaggagtagtcctactgcctgttatgctaactcactcaacattgtgccctgaagctacagggcacaatgaagccttgatcctggaccaaggatcaaattgcaataaaatcatgtcctatggtgcctggaactcttaagtatatagggagtggaggggaatcagtgttcaaaatacctggagcctgaaaacaagtctgtagaaaatgatgggaaccattagcaggttaaaaatgtaagtgatgaatttgtttttcattgacgcctggccaaaattatccttaattaaaaaccagttttaatcaaacatgctagaagacagactggactttttttaaaaaaattgtctttatataaaatgatattaccaaatatttgtcatctggcgtaacaattaatgagtatgcagccaaaaattgtatagaaaaattatttttaagctatgccaggcagttcataataaaaatattacattcttttgcttgtttatttgttttgttttgttttgattttttgagacggagttttgctcttgttgcccaggctggagtgcaatgacatgatctcagctcaccgcaacctccgcctcctgggttcaagcagttctcctgcctcagcctcctgagtgttcttattctggtttatgtgatgtttgtggtatttgtcaatttctaatatatatataagtatatatatatcttgtggttattttatcatcctacatatttaatacctaaatatctaactcttttttctacaccaaattgtataagcttcacatctcataaaattgggatccaacactggttacacttgtatcagtcagggttcagtcagagaagctgataagctaccgatcaatctatctgtctaccaacctacctacctataaagaaacatgtattataaggaattggcttgtgtaattgtctgtagctgctgactaagcaagtctgaaatcaacagggcaggtggttaggaagggaagatccaggaagggggaagcaattgtagaccgagttgttgattggaatctctatcactgggaggagcccaggccttcgtagggcttacttgattgagttaggcccatccaggataatctccttcatttagtggcagatactccagatactcagagactttcattatatatgtacaaactccttaacagcagcacctcagtttgtgtctgattgagtcactggcagaggtgtatgcatgctaccaaatgattgctcttccctttcataagcctagtctagcccagcggacacagcaaacacccatgccaacactcagtgttattggccaaagttgtctcttcctggaacagtgagagttggaagacttctgttgtcttggaattcatactcattaccttattagctgcatgtgtattttagctagtaaaattttacaaagggaagcaggtcaataccagtagttagccacaggggctgtgaagtcaaacagcctgagttcaaagccaggtttcatcatattctatctgtgtgactttaggcacatttccaaactatgctaatttttttcttttcttttctttttttttttttgagacagagtcttactctgtcacccaggttaatctcggctcactgcaagctccacctcccaggttcacaccattctcctgcctcagcctcacgagtagctgggactacaggtgcctgccaccacgcccaaactatgctatctttttttgagagtgtttatgttaaaatattttttaaaagtttaaacaagataatccatgcaaaatgcttaaaccagtatggatgacagtgcactcaaatgttagtagttaagagttaaatatcaactattttcaaccagagagcatactagatgcttttatttatactagttaatttggtctttataattagtgttgtgaagttattaaggcagaattgggtaaataagaaaaatactgtgagcattttcttcttaaagttgtagcaatatattcccgttttgttactttccataataagagtacatgtctagaatattttatatattactgaagcctgatatcatttttagtatattcttaattaagatgttttattatatgaatgttttatgaaatagaaacaatgtctcataaaaccaaatatctgcataaagttattacctatttataaatatttttattcactgatttttctgtaaggagagtaaatatgatcacaatgtttaatgtattactaaaaagaaacacatgatgtttaaaaaagttaccctgacatttttcaaactgctcttttatgcaaggcattggctgcattctatgttgggaatagagagcaaactactggaagagcaagaaacaacattataaacgggagatgctatagtactggcgcataataggtctacctggaatgttttaacatttttaatttggcctttataaatctacattgtgaacgagactctgttaagcagtatatgaatagattaatttgaaagttatcagaatgtgtaattgagaaaagcaccagtgttttgttagactagtctaggaaatttggactgtgagggacaagacactagaggcacttagaagactacagatgggtctccctaagcctgttttagaaacagtcttcaaggctagaactgagatgagtttgtgccctaggggaaggggccagtgcctctgaaatatctgacttcagttccttgctcaagaatggtgactgggaatcattcagcatggcttgtgattggacaacaaaaagcatgagcaggtactcttttatgtcaataaaatcagttgtgaccttaccagtaccctgtaggcaaaagacacaagagggtgattctccaggactggcttacttattcttaatgtgactgtgctttatgaaagaagaaaacttgtaaggcctacctgtcataattactgtggccaagatggcaagagaaatctcttatgtctctttacctagagagcttcagttaaatggagtttgatggggcacaaagtgttaaagggcaaggccgtccccacagaaggaaaactcatgtaccattaaagtctaaatgtctcaaatgagactatgtatgtgaaattaaaatcacaccattatagaactaatatgagcttattaagtataattagggaatttttgaaaccagaaaaaagaaatatcatgcatacttcagtcattcaaatacaatcactatttgattcattcctttaattttttttaatgtttatttcaattttgtaattatatcacataaaaattttgtacttttcaaagtatgatatacgataagcattttgagtgttatgctatgatatcttatgaacattatcttaatggctgcacaatattccattttatgattgcattatgtttggaactgtatacagtatggtctatatttacacttttggaaatagtctgctatatatctttttagtcgaattttcccccagtatttagcactgtacttaaaagcctagatgctagaattgaataaactcaattttaagccacttaatatttgaatgaccttggaagattatttctttttaaaatatttcagtattatcatctgaaaattaagataataatacctgctggcaggattggagtgaggttaaatgagatatgcatgaaagcaagatgcctgctacaaacttagtgcttgataaatggtaccttattattaagtgtatttcccttgggaaaagcaaaattattgtgtctaaagggtgtaaaggttttatttaatgtgtttcttgttacctactgccaaagtgtgttttcaaacacccagacaattaacagcaaacaaatcagtagacaagattttttagactctgttctgtgttatgaagtaaagtggcaaggcacattagaaggtaaccttacttgcaggagtagatggcagatataaattatttcaagtactatggtcccaaatatcaagattattatgttttgtttttgagagaacagcaaatgcaaaaggcgctggcttgagaataagcttagcaagtctgagaaacagaaaattgatctaggtggcagggacacactcagaatgagctggggtgtgacacggggatccaggctagacctggaggtgcccccaggtcatgataacagctcagatctggctcccagaatgatgtaataacactggagggtttatgcagagatgaggtgagtgttagaatcaggctgctgtctgctaataccatctcaattacttcttagctgtgtgagctgagagcaagttaactaagttctctgagggatggtttcttcatctgtaaattgatggtaataataggatctatgtccttgttttgttgtgaagacagaatgagatgcagcatgtagcaattctaaccactgtgcctggcctacagtaagaatttagtaagatttaacctcaggctcaatggcaaattttataaggtcaaattgattttgaccttataaattgattttataaggaccattgattttttttctcgaactcaaggagctcgctgccccttaatgggcattcaagtcttcatttgtagagaaagagaaaaactgtatactctcttataatggcatttctccattcctagttatcaagatttcaaaatatagtcatcccccagtatcaatggaggagtgggggattgattccaggacccctgtggataccaaaattcatagatgctcaagtctcccatataaaatggtgtaatatttgcatataacctatgcacatcctcttgtataatttaaatcatccctaaattacttatcatactaatactatgtacataatattatgtacatatttgttatactgtgttgtttcaggagtattgacaagaaaaaactatgtacatgttcaatacagacacaattgccctttttctgagtgtttttgatctgaggttggttcaccccatgcatgtggaacccactcaattcaagggttgtctgtattaaattgtaaagaccgactcaatcaggaaatttcagtacctaaataatgctttgacaaaaatgttaattttaaaatgtatgcatctgacttaaatgtgtttttatttatttttatttttaaaaatttcactcaagaagtatagaaagtgtgtttttaattaattaagaaagtctttacagggtcatttcacgtgattgagaggtaaggacactcacccaaaggcatagttataaaaaatataaatgaaactatgatatcaggaagcagtagtgcccacagaacaaacaatcacggggataatcagtaaatgtccaattccatcactaacttatagcctattttctgactcattcaattacaatgttcttgttctcaaattcaggtcaattttgctatcattccaatttaaaatgctaattttaacaaaaggaaatatgcttctctatgagcagaaatatttgaaattttttaagtagagatttttcaagtagtagatatttatgcacacacaaatgtacacacacacacacacacacacatttaatttgtcttccaaaaacataacatggcatcctactaagaaatacttacttttcctacctaattgtgagatccttattgttacttctataagttttcttacaaatcctacttgttctggccaatttttcagggtgatgacctatctcaagctgggtcaaagaccataatccttgctgcaggtgataaaaatgggaaagagaagctaacctaagctagtctgatagaggccattcttcagagttttgacctcgaaagagagggtctgacttttagctcttctctgtaggtacagatgtgaggctttagagaaatggtttccatgatcttgcttttggaagaattcaatctccaatagggagaatgagatcacttggcaaaggagaaaagcccacacaaatgatagaaagagaacacatgtctttcacagtctcaattccagttttctctgaggcctaggtaacatttctttctcatggttagaatggtttggctcactgccacttgaaactgtaggaatcaagactagttgaaattactatgccttattttcctcttttggtttctacttgccagaagattgcataactactcaacaactgccttttaaattaaagaatgagctctgtactacatttcaactattctttgaataactcttaaacatttggatatctgatatagtatgaacttgcactatctcatccaatctgagctttacctgaaagttggggctactgcctcagagggaccagatcatgtactctcttttggagtatatgaataagttgtataaaaataacagtatgaataaatattctatgcaaaatgaataaagggcctccaaataaaggaagaaattcaggagagtgacatgagactatgtaaatataaccaggaagacaacagagaataatatgttgtttgagaagaattataaaggttatttttgcctttttcttatttcaactctatttagggaataaaaaaatgcaatgaagaaataaggctactgcttgggaattgcaaatgtgagctcattttattttatcttctcttaaactatatatcataaagatatatgagagctcagaaatgcacctgggcaataaactattaggtttctgaaatgagttcaagccagggtatcaaagagcttattcaattaggacatagttactagccctcaatcagagattatggataatcaagtttgaaataaagactgttgacccattattaacaactgataaaataataaatttcagaaatatttctagtaatttctgtcaaaacatgtcatgagaatttttaaaagactagttatcactacctgaaataaattagtgagcactggaagtcagcataggcaccccaagaacccattcaattgagtttctaatcagttggtagaaactgtttcttatattctccacaatagccttttattaatacagattggaaaataaattttcaccttgtattttggggaggtaggaatttagaaagtgagtcctgtcctaccatggggaagggttttcaagtgcactgagtgaacaaaaatatgctcactctgatagattttcagtagaaagaaattattctatttttattccacataaagtttttattagaaaaggctgcttatttttatctaataggttttctgaatatattaccataattatctgatcatcccatttattttgctagatttcctgtatcagatcattcttgaaattttgcatttgatatgttgatagattcttattttttaagaactttttctatattcataagtaaaattagtctattattttgttttataccaccttcaattttgtggtattggtgtcactagattcgtaatcaaatgtgatatttgtagcatcagaattatttttcttatgagttatgtggaactcatctgtgaaataatctgtgtacatcttaaaatacttttgatctgtgtttaacttctggtcatttaattgtaattaaaaaatccgctttttattctaaatttttaactttgttaatagggattcaggtaatattcaaaatgatgtcaatctcagaagttcctctgattttgagatgatcacataatacaagtcagggatttagcaacagcccagagcttgtcatagtactaaaaggatttttcaatttgtaggactgccaaagcctaccacaagggaagtaccagtttatagaggatggggtgggaggaatattgagggaagtaaagatgagaaatggggaaggtaaagtactgatgatatttgttaagtgtctggatacagccattcctgaagcaaaaactacctcctggagtgttcatttacgtgagccaatacattctaattgttttatgccaacttgagttgaatttcttgtaaagtcaaaggatttggattaaaatattcttccctctctttctaggagaaaataaatacatattccaggcaaatgaaaaaatcaataatatagtttggctgtgcctccacccaaatctaatcttgaattataagtcccacaattcccatgtgtcatgagaggaacccagtgggaggtgactgaattaagcggcaggtctttcctgtgctgttcttgtgatagtgaatgagtcttatgagatctgatggtcttaaaaaggggagtttccttgcacaagctctctctttgcctgccctcatccatgtaatatgtgaattgctcctccttgtcttccaccacaattgtgaggcctcccatgccatgtggaactataagtccattaaacctctttttattcccagtctctggtatgtctttatcagcagcatgaaaatgaactaatacagtaaattggtaccagtagagtggggtgctgctcaaaagatacctgaaaatatggaagtgactttggaactgggtaacaggcagaggttggaacagtttggagggcacagaagaagacaggaaaatatggaaaagtttggaatttcctagagacttgttgaatggctttgacaaaaataatgatagtgatatgaacaataacttccaggctgaggtggtctcagatggagatgaggaacttgttgggaactggagcaaaggtaactcttcttatgtttttgcaaagagactggcagcattttgcccatgccctagagattcgtgaactttgaacttgagaaagatgatttagggtatctggcagaaaaaatttctaagcagcaaagcattcaataggtgacttgggtactgttaaaggcattcagttttataaaggaagcagagcctaaaagttcagaaaatttgcagcctgacaatgcaatagagaagaaaatcccattttctaaggacaaattcaagctggcttcagaaatttgcataagtaatgaggagccaaatgttaatccccaagacagtgaagaaaatgtctctagggcatgtcagacgtctctacggcagcccctcccatcacagaccagaggcctaggaggaaaaaatggtttcataggccaggccctgggtccctgtgctgcgtgccatctagggacttggtgccctgcatcccagccactccagccatgactaaaaggggcccaggtacagctccagctgtggcttcagagggtgcaagcctcaagccttggcagcttccatgtggtgttgagcctgcaggtgcacagaagtgaagaactgagcttcaggaacctccacctggatttcagaggatgtgtggaaatgcctggatgtccagacagaagtttgctgcaggggtggagctctcatagagaacatctgctagcccagtgtagaacggaaatgtggaatcaaagccctcacacagagtccctactggcgcaccgcctagtagagtatgagaagaaggccacaatcctccagaccccagaatggtagataacactgacagtttgtaccatgtgcctggaaaagccatagatactcaacaccagcccataaaggcagccaggagggaggctgtacccttaacagccatggggcaaaggtgcccgagaccatgggaacccatctcttggatcagcatgacctgatgtcaaaggagatcattttgaagctttaagatttgattgccctgctagagttaagatttgcatggggcctgtagcccctttgttttggccaatttcatccatttggaacagctgtatttacccagtgcctgtatcaccattgtatctaggaagaaactaacttgcttttgattttacaggctcctaggtggaagggccttgccttgtctttgatatgatgttggactgtggacttttgagttaatgctgaaatgagttaagactttgagaaaccgttgggaaggcatgattggttttgaaatgtgaagacatgggatttggaaggggctggggtggaattatatggtttggctgcatccccacccaaatctcatcttgaattgtaaattccacaatccccctgtgtcatgggaggaacccagtgggcgggtctttcctgtgctgttctcgtgagagtgaatgagtctcataagatctgatgtttttaaaaagggtagtttccctacacaagctctctctttgcctaactccatccatgtaagacgtgacttgcttctccttgccttctgccatgattctgagtcctccccagccatgtggaattgtaaatccattaaacctctttttcttcccagtctcaggtatgtcttcatcagcagcatgaaaatggactaatacaatcagttataaagaacctctcttatgtacataagaaaaatattgtcaaataatacaaccagttagatccaaatgatttctgataatatgactgtgacatttacagaaatttttattcaaagattcttaagagaaatttttgtataaattaaaatattgtagctagtagagtgatgttataccagaactattgttaaaaaataatagaggcttaattaagcatacatgcaaactgaaagggtggataaaattcagtattagtgggtggacatacaggagagagaaggatgctgagagagtccctgggaataggagggatttacaattaaagcactgctgggggaatgaacctcagggcaatggggagaagaacacaggggtggcccacataggcaagtatatagtgtcatatgccagtgagaatggcgctgtctaatggcttcaatattcggtgacataatctgcagggtcagagcatatatgtggagactgaagttgagggagaatggaggatatctgaaacagtgatgatgatgttcccttgatgttgctttccctgtcataatggtcagtaatcaatcctattgtgtaatgctcttcaataaacttaactgctgtagggcaggtacaggaaaagcaggttcttgggatcatccagacctggagaaattcagaagtggagggaaagtataaaagcctagaggtaaggaattctagatttttggcagaagggtaattcgttgaataatgggtcatggtatgtcagtaaatgaggaaagtgaagaaagaaggttgacatttttttttcaaatgtagatgtttctgatagctgtaagatataaaatcacttacaaaaattacacattttttaacagccttaattacaatcttatttagagcaacctgtgttttgattaggtattgtttagagaaagataatttaacgagatcgtttattcttgagtaagatttctgaaataattgaaaggaagaggaagataaaaccttgtggtgcctggtgatatagcactttatgttctgctcaagttcaaaagataacttttttaaagttctgaatttgaaaatatgatttcaaaatacttaaaaaatttctgtctttgcaattacatttaaaatgttgcttcttcctaactgtatatttttgaataaaagatgttatattagcttccccaaggttctctctttcttaagctaatcagtgggattcaagtgaaattaggtgaataaacaattaaaactacttaactgtatcaatataaataaaaatacctaaagtgctattcaccttaaaagtatttccagaaaaaccgcaagggtttttatcatatgacctctaattgaattattgtgctcactcttattcaggttaaccagttgaaaattttcttagaaccactttgtattaaaatatttctgtaatacataaataaggctaataagagcaatactgtaaaggcattactctaattaaaaaattctatggctactgagagttaagaagacataattttatcaattaacgttaaatgtttacgaacttagtaatgggatagtgagctccatttggaattccttcctgtctaaatatttaccattattaaggtgaatctcagtgtgatgactaactttttcagacttgctcagtaatttacaatatattattgcatcaatgacttgagcactgcgggaaatcaagtttaatcagtatattttgtgctaggaaaaacaaatgctaagctttatctccctttagcatagcatgtgcttactagaaatgctcaattaagaactttgaaaattgttggtcatgcttctaatttgatgcagcctctaaagaccagtatgcaagagtctttgaaattaatatattgctgagaaaataaaattcttcttcatttgggctaggaaaatgtgttttatttgttttcctaccattctttaccagaggaaggttttcctttcccttcaatattacctaaatattttgcaatcagataaataaaatgataaaatgagatgttagggcaatataaaaaaaacacaatattgcaatttgtctaacacgatttttttttttttttgcagtttgttacctctcttacatattttctaactaagatttttctattgcctctaaaagtatgtccagtattattttctcctctgtaagggattaaaataacaatttaagaagaaggaattagggagtctgagaaatacaattggtctttctaacctcccttcttctttcttccaccatttactcaaaatatttcaaactttcaaaccatgatattataagatatataaaggcctactttattcattcaggtagattaaaggagatggagtatggggccaattgtttattacggaaattctgacgtagtagttgtagttcttgttactctttttccatgcttttatacttctaatttttaaaatccataactctttcagctttgaatggctcaaaatgtacctgccacttttgcttttaagtatatcaaattcccagtgatttgtcaagatatgtgtatccatttagcaacaaataaatttcatagaggccacaaaatatagaggcaccatttgtgaatgagggataagataacatgaggttcttgcagttgttctagaacatggctattagatgttctaaccacagctgaagcattaaatattacatggtcatttttttttctacccaggggcagcctctaggctaaatgttttttattttgacatttcctttgcagttctatgtttagcaagtaaaaagtaaaacataagatagtttggcaagtgtcacaaattaataagtaaaataccattaaataaagacctgatttgaatacagagtccttcactcttaggcaggtaaccctttggtaaatttttcaatatctggaaacttgacttatttactcaacacctgttaaacacttactctctgcaaaattctcttatgggtgatatagatactgcagtgaatctgcctttatgaagctcacattccagttggggcagacaggcattaaaaagggtgaaaaatacatgaaatttagataataagtgtaagtcaaaaaacaaaaacaaaaacaacataggagacaagaactaatataggaggactaatattttagatagtgtgtgccagaaaggcccttctcagaggtgacttttgcgtaaacatgacttgccgatatccaggggaaaagctttccaaataaaggaaatagatgtccaacaactctgagatgagatcaatactggtatattcagggagcagcaagaggcccatgtggccagtacactatgaagagtattaggagataaaaagaggaaaatagagaatcatcagggaactggattatggagcaccttggaggttatgagaaaccatgaaggctttgagctttggcatgacaggataacttacatttttattttttttttagaatgacacaacctactagaatgaaaatagagtgaaggtaggctagtcctgaaataaggaaactgattagaaggcattgcaataatcaaggataaagatggtgccttggaccagggcagtggtggtggtgacaggtaatcaaagattgggtctaatttgaagaaacctcaatcaaatcctactgaagttaattagatttgcaagactattgtgtttttgagagaatgagaaaaatcacatagcttcagtctcttcaccttaaaaaaaaaaaagtatatcatttgctcatttgccttgtgggttgttgtagaaacatattataaaaattaaataaatggtagttattatttgagctatttgcactagttatatttagactatgccaaagactgaacatgccattttataacatagcttttaggaagtaatacttccgttctgagagcaggaaaacctctaattagctctttatgctcaagaaacatttcttcttctatatttatatgattttgattagtaaaggttatgatctgtagagatccaagtgactcttcataattgagccttttatccatggaaggcgtctcatccagtcactttccatttggttgaacatcttgaggaagagtccctttcactggtgaacatagtgaactattcagttctgcctcagcatgctcaatctagaaatcccaaggaataggaggtgacatcgaccatgaagagctgccttattcttataaattttaagtgcattttgtagcaagttaaagcagggtgttttgatgctttttgtcataataaggaattccccacacatcccctacatttttaggaaaaagtgtctaagtcctaaatatgtgctaaaatccatctacagaaatctatcaacaactaaatgaatagataattttctccacactgaaatgtgaaaagcttgatgcattccaaatatttttgcttgatatatacaatttgataaggagaatctacagttgctattacaaagctaggctttcagagataaagaagagttaaccgagggatgttggagcaatagagatgaattgggctttgctatcctgtatctaatagagccaagattgctccttagattgagaaaaaaagtcagccttcttcagggacactagacagctcagggctagaaatttgaaacttattcagtgccaggaatatagaaaataataattagaattgaaggcagaactgagtttaattagatattaggcagggtaagtactgaacagggtcaggtgttcttcagaaataactctggatctctccaattagatatactaccctgccccccaaccaggtgctctcataacttgatgtacttgtcctttttagagtaacaaatttacatttattttgttatttgatcaatattgcttacttccaatccattctaggtctataatttcccctaaggctggtttagatccccattatgaactaagaataagcacaatacatggcacatataactcaatcacttatggaagaaagtgaggaagagataaaaaagaaaaacaggtcatcaacatttaagcaaattaaatgaagaccatcctgagatatagctggggattcacataatctctaacatagacatctttggaaaatggacttttcttacaccccttcactattttaaaatctaactgctctcattctttactccttcccatgtctattgaccaaattgttcatcttgttgtatttgggtgttatagatcatgttgtcaatgacctatgaaaagcaaatgaccttattttcaactttctatactttagtttcttctctgaaatatcccttttgtctgaaactcttcctttcttcaaatccaagggaacatcttcacttcctttcaatttcataaatttacctaaattatttccaggtttcctggaaactctaatattcacccattctcataattatttttgataggatatgaagtaaatgtcagtttatttttctgcttataattttgcaacttaagttatatcaatagtttaagaattatacaacacttatctaccaaaatattacccaactttgtgtgaagaacattggtaaaagcttcctacagattattaataaatgccaactaataatattacgctgatgaaagggaacaaatgccaaatgacaactcaacagccatcctaaattatattaaaatttgaatataaatagatgttcaaatgcaaaatagataatttttatccgcatatatttactggttaggcttttttgaaattacaattataaagtaggcaaacttggttataagcatttcttatctgatatattagtgtttttttattatttttcttacaagcacctattatagtaatgttctctattttccatttaaatttaaattggatttaaattttccatttaaatccaaaattcaaagcaaaacaaaatacttttaatataaattacactaaggagtagaaaattatattacacagtttgttgcatcacccacatatagtaaaaataataaaactagtaactcttcttctttgaaatgccatctatcactaggttgcagatgaggtagaggtggacttattcctgatttcaaaatcttaccattattctccttcttattaaactaacttttatgactgatataagtggttaaacacaaaataaatcaccagctcatttgtagctatcatttgcatggtacccagggaatcccacactattcaatggaagacatgtgtagcgatctaaataagtgtaaaaatggtaattcttctggggtgcaaaggaaatgagtgacctaaagagaatttttgtttttctactatattacttgtagttgacaattcttttaatatttgatatgtagataattacatattattggcactttgaagattgatttttactattaacagaaaaattattttaataataatctgtgttttgttcatgtaatattattttgagtaaaggatttccaagggcattttatttttgtaaatgtcctttgaagttttgtaaatgccttttgtaaatgcctcttgaaataaagatcccctttacagcaaagaagactttaaagaagaaactatgttttgactgccacaaaatttgaaattctgctaattaacctagaaacagaaaatatagcttactgttatggaatctatttttacacacacatacctacacagtataatattacaagatttttggaatgactatgtgcaattatttggactttctgaaatatcatgagctctacaagaaacaatacatgtttataatcatatctgttaataatttctgttcctttctccaaatgcactctcttggttctgggtttctgatcatttgggggaatgtctataatgttagtggctcagcaggatcataaataaataaaagactaaggcaagaataaatggcattgattattattgtacattcctaataattttataatatatattcagaaacacatgtgtttgaggatgtacctaactttatatgtctgaataatacttactcatactcaagcaatattccaagtgtagcaaaaccgttacactttggaaagaactgaaaccaatataaaaacaaaatttcatataacttaagtacaataataaaagtgaaacatattgagaccgttaaactttgaagatttttttttcagaaattaaaagctataacctatggattaagtttatacctgaaaaagagtgtatttcttctatttgtctttgtgttgcatcctaaaggattggacgatataaccaaatggctccaaatatacttcagatatgagtaggacccatttaatgatgcctgaggcctggagtcaatataacactgtgattttagccacatgattgtttcttcattgggttaatttacaaagcctcatcagaacagtcaaagaaatggcagaagctggggatagatggaataggacaaagatatctagacaggatgtaggtctggcaagtcttgatgagctgtcaagctatctaaatcactctgatcaaaatctgggtggacacacaaagaagcttgatctataggcagagcacagcagatggattttctcaactgtagcaatgccctgagttatgtgaggagtatgattctaggagatttgcacagccagtgagaatctgttgccagtctcagggagtgggagtgggaagcagaatcttagaatccttagaatcttagaatcagcaagctgattgaatttcaagagaaagctcaaatcctaggaggaccaaccatagtgaagtcaagatactgaaagagaggttaaatggtacagtgtaaaccatactataggtttaagcagaagtctacagaaaataactctcaccccaggcacattggataccagattatatcagatttttcaggtattggctgctaataatatttcccactgtggcaagtgtttacagtggtaagcatggaaaattggtttcagtgacaccagcaaatcagcttattccattagtattagaactctaaacaattatatttatacttccagatctgacttagatttttgtatcaacaaggtcaggtatgaaggatacattgctgacactgatttcttaatgtctataaatgtcttcaaatgtttagataacaatagtaatacacacacacacatatttaactacctacatagatataaaacaaaccatcttctttaaaacaaatgagttctctaaaataattactatttatatgatttctatttttcacatttttgttctattcggactggatttttacttcttcaataaaatgttatttattactggtttctaataagtaaaaatactatggtgaaaaactgcagcatgacaatttctataaataatcatttataaaataatattactgaaagaaaaagacaaatatggactttgaaaaattgccctgtagctctttttatttcaaggggacagactgtttctgtacatggtttcattttccttgaactttctttaggttaatctttccaaatcaagtaaccctgttcagcattcattctgtaagtttagaatatgctcgccaaatcaaagctcttttgaaaaatcgaagctgcctttgttggggaacattcataaattgacatgttttctatgtttgagattttctactttcttccctttcacctgcacacttcaagatttattacagattgtcagaagaaatgattgccttcctagttttatagaactccaaataagaaatctaatttgttgtttctcttggatccctggttaaagtttctgaatagtttggggcagaactctttttcctccataagtaagcctgttttagtagttgaaaaatgttcttggagttgatgaattgaagtacaattttttttctgcttttaattgctccccaagtctgctatgttcactctgcaagagtgagtattaatccatggaaccgtggttaattgtgaggtgggtaaattcaatgatgtttggatatttcacttggatgcatgaacactctatatgccactcaaatgacctcattccatatgccttacaagtgtctctgtgacactctgcaggattttttgtctatgtgcaaaggaggcacacagctgttaattgacaaggtaagtaattgtcttctgattacagtagttaaaggctgttctctaatggattttacttgtcacttttaattctttttaatctttgtctgcatttcattagaatggctttatcatttggattgccctcctgttggttattctgataagatttaatgggttatcttccaactatgacaatccctcaaaaatataatagagtgatatttagattcttccgggatttttaaaacacgattgcttttccaacccattttttctcttttacacttcacatttttgcaaatcaagtattttgcattttctacatgccctgagcaagtttctgctttaatcttccatgacttaatctattgactaaataggagatagttggtgaggcagttaggaaagagcctgttatcattttctattctgcttacctgctgtgattttatttatttatttatttaatttacaagcaataggctttaactgcagttttctaagagatgattcaggtactgacaaaaatatttgtaaaccttttaggatctggggataacagaaaagtaaacttgtaaaaatggttcattatgcatttcgtgatgcagaaatgtaatgttaagtcatcatttattctataatagagcatttttaggttttgcatatgttcccctacctatgaaaatgacaatttacatacaaatgcatatctttaatcatatctcactcctctatagctagtgcatttaccaaacagctctttataaggtgtactgtaattactgaattatgcagtcaaggtgtctggttagtggaaataatttattgatgtaataacaactattaaaaataaaaactgcaaacatttgtgggaaagagacaagatagaatatctggcctttttaatgtttaataaattgggataaattgtcctaccttggtttcaaatacaattgagtcatttaacaatcatatttggcaaaggttgtatgatgctgaaccatgcagcagatggtggaattacagaatgcaaaattttatgggatgccttttcagagtttgctaaagtgagatctagtgcatggtttttataataaattaattcttcctagaagcttgtgtgtaagtaatttgacaaaacagttataataaaaatttgtctttgtataaaattgaatctatacctaatgctaaatgatgagttaatgggtgcagcacaccaacatggcacatgtatacatatgtaacaaacctgcacgttgtgcacatgtaccctaaaacttaaagtataatgataataaaaaaaaattgtagtgccaaaaggcaaaaaataaataaataaaatacataataactttttttaaattcaaaaaaaaaaaaaaagaaaggaagcacaattttcgaaggactcagtgcactcattggtttttaagatgtaccagtgaagtggtaagtcaaaattggtgtatatttggaagcttaaatgaatttcatttttggtaacgtaactaagagttttaaagcataagtatgaaaataagtaagacaaacagtgatcattttcaattcttgatttgcccttgtttaaattgtagctgcccaaaatggttgtgtgactctaacctcaactatcatatattttctgattataaaaaaaaagggtccaaatgttaagtactaaatgtgcttatgagatattataatgcttcaaagtcccagaagtgacctcaaatcatttgagtaattatgtagaaaaggaatacataaatattaacattaataacacataaatacaacatcaaaatacactaagtaaatattacagttatttaaatatgcaagtgctttgcaaatttaactagttttgatatctctttaaatgatttttattcatagattcaccagaaaatcatatatttgattctatatgttagtgtctgttgaactttacatattaaactaaaattttgttaaaatgtggaacccattggtagaagacattgactctcaagtatttcatttatgtttatcttctgtgtgacacataaaactagtaattctactttctactttctttcttttcccaaatctttcattgctttcttctactttcctaccgtaagaaatatatgtactatgtactgggcagagtcctctcttcttggccaaagctaaattacaagaggttatacaggaaatgtccatgttcaattagaaaatctctggaaataaagatctctcaacaaaatcatggtagtgttatgtgcttatatatataagcttacacatatatgtatataaatatatatatatattaatttatttcgtttccaccataactcttcaagagagtatatttgattttacagacaagaaaattaatttgcccaggatcacacagtttctaacagaaagaaccacaaacccaacccagtctggctgaatcaagaattgttcctctcagtgttctgttctgattctctattaagtttatagtttcatgattattactgttaaaccttgagaaataaggccaaactgaaaggtggaaatatctagaagcaagaactgaccctcagataaacactaaaagggaaatgacatgtaaataaattcccatttatgaaaacctagaaaacaaaggcaaggtggatataggagctgagaatgagatctggaacccttaaaaagtctagaatatggtagccacttgaaatctataacaagttattgcttatttgtgacatgctttttctcacttttgaaaatgctttgtaattaattttcaaaaagagcaaagcaatgtattgtgagtcagatctatgagtaaaggccccatgtaataaggactggattcagtttattcatcgccctaggtccttgcacttgccttgccttgctctctagccagaatatccctggtactaacttctatcactcctgcatcctagataagagtcacagctgctgtctctgatgttgctcttgtttgggagcaaaccccctgtcatgctccatgtcctctacctctgggcttccttgttgcctcagaccacctctgcacagtatggacatgctgagagttaacaccttgtggaggcaaacattgaacaatgtgaaatgggaggcagttgatgttttcttccttcttcttcccctagctagattttcaaaggtgtagcagctacataaagcctctctaaagactgaacagtcgtcctgctacagaaccatggccagcccagcaaggctctccttctttatatttgctattccacctcccttgccacattcccctttgctctcatttctctccatgtgctcctgggtaaggtgttatcacataagcctttttttcctttttttttcttttttttttttttcctagggagtctaaggagagctaaagtatagcatactagcttaaatgtagtttaatttctatgaagattacatgcagttcccttcaaaagttttccttaataactactttttattgatttttatatgattaactctatttctcagctcattgctaattcttgaacaaggaattcttcagtgttaaaattaccattctcttgatgtaacaagacataatacttcattatgttgtatttgttacctaaaaatgtgctgtgctcagatacagatggctatgttttcggaaaaattttttttcccatttctctgaataggtatatatagaatcacatgtgtaagtatataatgtttatatgtatatattaacctttggcagcaaatgttgtcttaacaatttcttaatagcctcctctgtaaaatggaaatgagtggtaatttaactcaaccactttaaaatgcttcataagaggtagagaaaaaaaatttttttttgcacccacacataccaatacaaatgcacacacatacccaaacacaccaatcacaaaagcagaaacaacatcaaacaaaacatctaaatatattaaaatttaaatattgaaatataattaaaatgaaattaaatttatttttaagtcaaagttattttagtttgatacttgcctgaaatgtgcaggtggcaagtacatatttaaaatgcaggtgttgtattttctgctaactttacttttgaaagactttcaacatatcatttcttatggaaaattatactcaataattctcagctacacagcattgacttagaatggattgtaggctgtgctaactgatatataaggtgaagaacccaaagatctatgtgtttgaattgtttaaagagaaaaaaatagcctaagattttttctcaaattttaaaagtagttgttacatttacggacagtaaaataaatagatctggccattacaactgtgaaacacaataggaaaataagcacaaaggatattcttagtttccaacatctaattgcaattgggctttctcttcccatcatcattaattaataatagataacatttatgttgcatgtactgaacatttctcatcacatcctcaatatttaaatacaaagaataaaaacttcactgggataccatttttgtctgttttgtttattgctacgtctttacctcatagaaggttcctggaatgcagtagatgttcagcgaatttttgtggcctaagtaaatatgaaaattttttaaaatgctagaaaaaaatgtaagaagaaatgaaaagtttcaggatagaataagagagacttgggatgtattttcaggatgtgattagttagttcctctttatctcctaaataaatagtacaatgtttggcacaaaggaaaataatcaacatgtatttgataaaataaatgtaacccaaaatattgtatataggtatagttttagtttgttgactacttataggtatttagtagcctcatgatgattattggattataaagatgaaaaaataggaaattcagcattactaattgtctactttattgaaaaaacaattacctagctagtaatttgaggactttggactgcctagccaccagtaatacaaatacacagtttttcaatggctttcttccttttccccttcaaaaaatacaaaaatactattctggtctttaaagatttttaatttgttttggcaggctgcatacaggcacatgtatgcaagtaaaaatatacatatacccacagagagtataaaggaactgaaaatatttaaaaagctattaataaagactgatacagactataccaaatgcaaaaatgctgagaactgcacacgtaattaaaaataaaggggtgatcagaatcaggcaataagtaacacattttgaggaaagtttggacgtaagtattgagtatgtggatgagctttccatacataatgcttcgtctaaatttatctttcctgttttcttcttccaaaatttacttcattttttatcagtaaatttaatgatagcttttgtcattgaataatatgaaagattggctttagcaaaccacagcatatctaaaaattcatgagtttagggatgctaattatctcaggataataatgccagctaggaaaaaaaaaaaagtaaagtctttcaaattaagtgacttagatgtaaattagatgtaaatcacacatcattttaaagagagaaaaacaatttcctttcaaacatggtgagacctagccaagtcagcaacagaaacaaatatgtagtaacaggtggcaaaaagtttattattttacaatatttctctattagatttgcctcaatttcttgggttgagtattttcagagctttgaatgaatactggaatttaaacaagttttctcggtaaaagtcgaaagtagataactagcctcaggaaagctaaaagtgtgtgcaaaagggaatgaaagcatgatatggtggtcttggtcataatcaaaagcaaataaacaagcatttgattcctgaggattttaaatttttcaaggatagacaatacatcccacaaagagcacaaataaaacatacttttatctttccactttcccttgtgtggctcattctccctctcactgtaaccacctacaaggattcagtgcctttctatggcacttcatactgagggcttccctcctggggttttggtgaatgagtgatactatgagtttcagaggttttcttctctccttgtctccatcaacatgtgcctattcagagtcttgttttacctccttgagaaggcagtagccgtgtaagttaaggggaattcttatgcacagtttttttttattctttatatttacttatatattcaagcatttatttacatctgttaataaatgtatctcatgtgtcttagtttgtgtaggctattataacaaaacactgtagattaagtgccatataaacaacaaacatttatttcccattgttctggaggctgagaaatccaaaatcaaggggccaaaacatgtggtgtctggtgagggcccttttcctggttattagatggtgccttttagctgtatcctcacatggtgaaataaacaaaggatttctcgggggtctctctacgggcagtaatcccatatgtgggctctaccttcattactaatcacctcccaaagtccctaccttctaaaagcattgctttaggcttaacatttcaacatatgaattttgggggaacacacattcagacgatagcatcgtggacacttacgttatactttggattttactctaacattgatttcttttcttttctgttttttttttttttttttttttgagatggagtctcactctcttgcccaggctggagtacagtagtgccatcttggctcactgcaagctccgcctcccgagttcaagtgattctcctgcctcagcctcccgagcaactgggactacaggcacgtgccaccatgcccagctaatttgtgcatttttagcagagacagtgtttcaccatattggccaggatgatctcgaaatcctgaccttgtgatccacccgccttggcctcccaaagtgcgttgatttattttcttcctcaaactgtaccagctttggctattggaaacttttgcaattgtctcctcagctcctttgacatattcccattattgtgattatgattatttttgaacacttctttacttgctcacaccaaaagatggtacagttcatcttatacatttttaaagagtcctggttccttttattggagggtagtattagaaaccaagatctgggtgctagatgtattcattgttactgaggtattgttgcttctaggccctttttcctgaaagagcaagggaatatttatgtatatactaaatcatacatatacatatattcataaatctgtatatatgtaaccatttgtatttgtatgaaaataaaaatgagttcatattgctatttccattgctaatccattactgcatggattgttccagctatctcccttaacttatttgtagcctcccactctaactctgagaaaactggctctaaccatcttccacttatttatctaactgttaaattctagtatacataaatgatgcttttaaaactgctacctgtacctctgtgggaaacaccttatcaattagagtatagtgctgtgtatactaccttgtgccttttgtcttgatgaaacttccatttccaaagttatttaggtaacttttcccttttcctctacccttttcagtgaggttgtttcataattcctcatacagtgagattcttttgtcaaattcagcattccatgctgggatccccccaaaacttctaaaggagttttaaaaaatttgtatacatcaaggttcactctttgtgttttaaagttctaggtatatcaacaaatgtaaagtttcatgaattgaccactatggtgtcagacagaatagttctgttaccctaaaaatgttctatgtgtatgtgtgcacacacacattgccctgtttgtacgattatcttaaagactaacattggtaaactcgactctgtctttggccaagaaaacgttcaatctgcagacttctatgcattgaagtccatgtgtctgaaggaactgccaaattattttgcaggtttccttggggaggacccccttcaacaggtatagaaaggtccaattatccaaggttggtcatttactagttcagatactgaaacatattttagctcaggcattcaagcaaatgaccacaatttacctggaagtgagttagaactttgagaaaccactcaaattgttgtgggatagctcccttcactactgattggcagcttaccctgagttcacagggctcagaagcccaccaggataggtgacctactgttagctagttaaatgtctttaggcaataattccatatacaaatagaaagattttagtcaaagaccttacaaacactttatactattgtcaaacatttgggaggacagaaaaatgaagatgcggctaatatttattgcaagctattgaattgtagatatcattctaggccatttaggtcacatgttcattctaaaagttctaaaaatctcaagtaacaaagattttactttgttgaaccaatgtcacgatgcctgtataaatcattatctcccttcttctgaatcagtactgtgactttgttttcaaatgtttatttaacctctgtatgtgtgtgtgtatatatacatttactttctttaaaatatgccatatcaggaactctttccagttgtctttttgaggtttcctaaatgctgagaaagtctacctttcttacgcctactaaacattgaattgtctgctctttcctgtttgagtcatatgaaattgcctccactgctgtccataaaacaaatattggagaagatatgggtacactcacttttttaaaaaaaaatcctggaattttaatacgttagtcgctgagatgcagtagttttcctaccctgattgatggaaactcttctcctttgctacagtgtgtttctgatgaaaaccaaagagttgtttatacatttttttttcagtttgtagactttttcaaaacaaaaatgatgattaattttcagttaaattctttattttgcttatgcaagtattgataaacctattcacattaaaaagtcattacatatggaaatagacctaaaaagaatagttgccttaccgtgtcaggatttgattcaattaaaactgattgagtaactttggaggggaacagcagaaaatcatatttgttttaaagttgagtccctagcaatatctatcatggtcttcatttattttcaataaatacgaaagttaaaatgtaagtattacccccaagaatatgaacatgaaaactcttataatgtgctcttcttgtgatacaatgtttttgctatggtttgaatgtttttgttgcctccaaaattcatgttgaaacttcatccccaatgaaatagtagtaggaagtgtggcttttgggaggtgatagaagcatgagccctccaccttcattaatgagactaaatgcccttataaagggatttgatggagaggctttgtcttttttgcccattccaccgtgtgaggacacagcatttcttccctctggaggatgcggtcacaaaatgccatcttggaagcagagagcagcccttgccagacacacaacctgccagtgacttgaccttagacttcccagcctctagaactgtgagaaataaacatttatttttttgtaaattacccagtctgtggtaatcagttgtagtacacaaactaagacagtgttgtattttatgtaactgtgcaagagacaattataacaaaatgagagcatacattgataagatacatctgaaccttgtctggcatttggattagtgattatgtagtcatgcacaagtctaaaacataacacaggtcagtgtaaatcatcagtatgtttaataataaatttgtgaaggtatacatatatgcaatgggaacacaggaaaaactctgttactagtttagcgtaaaactaaattatcagataattgcaaaaattaacaaatgagaatcccaacaagtcaaaatttggtataaaatatttgcatttacatttgtttcctgttaagtttttaaactctttaaaaatagatacaaaaatatttttagttaaacctttgccactcccctagaacttctctatagaactcatcaacagtgcatctctatagaactgagtttgaaaatcaactcacgcctgtaatcccagccctttggcaggccaaggcaggcggatcacgaggtcaggagatcgagaccatcttggctaacatggtgaaaccccgtctctactaaaaatataaaaaaaaaattagccgggcatggtggcgggtgcctgtagtcccagctactcgggaggctgaggcaggagaatggcgtgaacccaggaggcggagcttgcagtgagtggagatcacgccactgcactccagcctgggtgacagagccagactccatttaaaaaaaaaaaaaaaaaagaaaatcagtacctcagcagatgagaaatggatcaatctatggtgtgactagacaagttaatgttaaaactgaacactgtgatgatgcatggcagctctgacaatacaagtaggatcagaatgtaagtgtggaaattcagtgtcactagggaagaatgggctgagagaaagtttaataggtagagaataatcataaaggaaagagttgccccaggactggaggggaaccaggtggaagagttgatcccgagactgatgtgactgatgattcttatcaaatgctcctctttgctggccttgcttagagccttctttggttgtttttagtggttgctttcgactcaaaagtgatctgtttattgtagtgtgagagatcatatatttgcagtcattgctgtccacgttattacttggatagatgtttttcccagttcctgattttacgataatccagttcaaagtgatatgcatgatatttcaaaaacagatgtcataatcttttctttgttttttaaatcattagattgtctaactcattgatatttttgaacatgggctttctgttgcactcctcatcgaagtaattttcattatgtgttgttttttctaagtttatttatttttattgcaagtggccaaatgataggccctttctagggaactatgtctacacaaaataaaataaggttaaaattatgcaatgaaactggcacttcggtgagctgtaaaccttctctgtagacattgtccttagatcatcctcacacctgtaatgttgaattattccctccctaggtttcattcctagcatttctgatccttaatctctgcttatccagaaagtcattttcagttccagggctaacttcctgaaatcctcacagattgattcaggctaaatcctgtattcaggttcatgttgaatccccaacgaaaattaatgggatacgtgcagctgcatctctggacagaccacacctcatcttgctttctgcaatccccgtccctcacttgcctaaagtgctttgagaactgttgtgactacttcagaatgaactatgtttctgtgactctttcttgctggctcatttcacaggaagcccgaatttacttgtacatggctcacagatcaatttctgcagtgtggatgtttgtaatatacataaatgtgttggatgaaggcattgaaataaaatttttgagtctgcaaattaagctggaattgaaatcagagaaaataatgaaaggcaatgaaaactgattcaaggagaagttttgagtaagagtgccaacaggcaccaaatcattttaaatgaaggcaaatattaaataatttaagagcgaagaaccaagctggagactatttcttaaatagaataatgaatcagcagttcaatcattatatggtttgaaagttattatggaaaaatcactaaagctatcaactcaaataaaacctaacaagaaattaatagaaatataataatagtgtgtattttgaaagtgatgaaatacctatcaaaacattaaaaaattataatacaggactctgattatgttactgtagaaatattctcatttgcttaaatttgtgagagggtttcttgagttggaaagcccacaaagatgcaaactctgatttattttataatgaatcttctttctgcaaattcatttcattttcctacaaatgcatcacctgcttttttctataagctgcttgtcttagtacaattatctactttgataaggttgtgcttattatgtcatattgcttagctgtcatttacctagcaggtaaaatacatattcagaagctatataataacataataatgtttagcacattcttatcgtgcactagcttggatacagacctaagcactttacatataatttataaaatttctttaaggtaggaacaattaacattttcttttattgatggggagactaggaagttaagtaagctgtgtaaggctctacacaattagaaaaagagcctggattcaaaccctggcagtttttgcttcagaatccatgttcttaatcaccatgttatccttacaaattcagtgcaaggcaaaaagcatcatcataatttttttttttttttttgagatagagtcttgctcttttgcccaggctggagtgcagtggtatgatcttgactcactgcaacctctgcctcccggggttcaagcaattctcctacctcagtctcctgagtatcttggattgcaggtgcgtgccaccacacccagctaatttttgtatttttagtagagatggggtttcaccaacgttggtcaggctggtctgaaactcctgacctcgtgatcctcccacttcagcctcccaaagtgctgggattgcaggcgtgagccattgcgtccggcccataacaactttttttaatgaagaaactgagatgaggagtagctaaaaacaaagaaacaaacaaaaaacaatgctaaggttatagagttcttaaataactttggattcaaatttcattctaactttaaactctgtgctgctcctacatgacatttgcctcatcttatctaaaacttgtcattccttatttctttttaaatggggatgaaggagatgaattaatgactctgaactgtaaactgccaaaataaataagttaatatgcatttatttgtttataagctcaagtacctgcctaaacttcactaaattttgtatttttatacctggtcataagatgaaaatttcttactgaaaagtaggttgtgttgttttaacaagcaaactgaaatgaaatcttgaatgaaaactataattcaacagtgcagtacaattatatacgtttgaatatttatattatatatattatatattatatatatattatatatgtacctatttgaataacatatattcacacacacacacacacatacacacacaccttaaaggtggcatgggaatggaatgtttaagaaaaataaaaaggctaattttggctgtgatgatttcatccttgaggacacctccagaaggtgagattacagagctaaaacctgtggaacttccaactcactactatatcataacttgaaatctagagctctttctttgaaaggatgatctaaggacagctatatacaaatatataataaaaggggaagaaaaaataatgtaaagcaaaaattattttcccaaaaatgttacaatagaagtccacatgtttcacagtttgggtacatggtttaaaatccacctgctcactgggaagcagcagccactaagaaatagatgcacctctaggggctgggaaaaggtccagttcagtgaaaggaatatgatgttctaatgtgacaaacaagaggagttcgcagttcaggtagacggtgggcttcatggatatcaaaccaccataatggaaatgttgcaattgataggcatggtgatcaagagttcaaaagtcatgtccacaatttgggggtttttagagctctacatagggaaatttctcagtaacggttgtgttggggttttgaggtaagccatcatcccatctaggtgaacttgtaagaataaggcaaactttagttctagaagtattaggtaactcataaagacaaaggtcaggcttagagatgagatgtaatacagaagcagctcaggacaatactgggtgacagtgaggactggactgaactaacaacaagagtgacttcatgttgatacccagactggtaccatccttgatcttggagaggcttcaatcttttaggtattgggtcatatggctcatctgaaagaagaggtaaatctctaaggctagaacctaggtagaggttaacaaggtgtatttcagaaacctcagattaattaaatgagtgtttcaaacacatgtattttattgacagtttttcccttgggaaaaatgacaagaaaccatattttttagactaatggaacagaatagagaacccagaagtaaatccatacatctacagtgaactcattttctaccaaagtgccaagaacagacattggggaaaaggcagtctcttcaataaatagtgctgggaaaactggatatccatatgcagaagaatgaaactagacccatatcacttaccatttataaaaatcaaatcaaaatgtattgaagacttaaatcgaagccatccaactatgaaactactacaataaatcattggagaacttctccaggacattgatctgggcaaagatttcttgagtactaccccaaaaacacaggcagccaaagcaaaaatgaacaaattggattacatcaagttaaaagccttctgtgcagcaaaggaaacaatcaacaaagtgaagagacaacctatagaatgggagaaaatatttgcaaactatctctctgacaaaagattgattacaataatatataaggtgttcaaactactcaataggaaaaaatctaataatctgattaaatatgggtaaaagacctaaatagacattttttaaaagaagacacacaaatggcaaacacattcacaatataaatgtggttcatattgtcacccataaagagatatgaatatgttctattttaatcatttttcttcaaacttaaattcattaatggaatattccattgtatgcctgtaacaaattatctcacatactacataaatacatatacccactatgtactcaaaaatattaaataattaaaagaaaccataatataaaaatgaagtttcaaggttatatgtgtgtgtgtgtctgtgtgtatgtgtatatacacaggtatgtatatatttaacctctgttccattggaaaaccaaatgtaattcataccaaaccacccacaaaaagaaatgatacattctattgtcatcatttttcttcaaactgaaattcattaatgtaattcaaaaagcaatgcaatttcaaaagaaatcatttaatgtagcagttttagtgcacacagtctgattcaagagcatttcatttactcatgggcactatggcaaaactccataatctgtattcattatataaaacagttcctccggcaggcatgtttagctttgagctattttcatggtgtgcatatcaccaatttggcgaggttggcattcaaacagaagtatcagaagtgaatattttgtatacttatcagatatattcatttatgacaatatttctatttttataaaactctcaaagtgatattctctatttgatatacagtgtagttttaatgatgaacataaacggctactcctgtttaaaatataaaattggatctacttatggtaataaaatatattaattatttctcacttttaagactataaagaagtctaactcacatttataaaaggtgtgaaaaattcaatttctcacaacctaaaaagcatacaaaattttactagttttattacgtaaaatcaggaataattgattataagtaactgatgtaaaggtaatgtaaaaactacctttcttttcacacttaatttatatatgatattacaaatttatttatgtattcatttatttgttttagattcggggatacaagtgcttgtttatacatggatattacatgcttaatggtagggattgggcttttagtgtacacattatttaagtgttggatattatacccaataggtaattttttaatcctcatcccccttcctttttccctccttttagagtctccagagtctattccttccatctttatctacatgtgtgccctttgtttagctcccacttataagtgagaacatgcaatatttgattttctgcttctgtgttagttcacttaggataatggcctccagctccattcatttatagctgtgtagtattccatggtatatatacaccacatttttttaatccaatcaaccattggggacacaggttgattccatgactttgctattgtaaatggtgctgtgataaacatgtgaatgcaggtgtcggttttacatgatttcctttcctttgggtagatattcagtagaaggatggctggatagaatagtagttctattgctagttctttgagatatttccaaactgttttttccatagaggttgaattaatttgcattcccaccaacagtatgtgagcattcctttttcttcatatctgtgccaatgtttgtttttctgttttgttttgttttgtttactttttaataaaaaccattatgagtggtataaaatgatatctcagtatagatgttgcatttctctggttagtaatgttgagcgttttttcatgtgtttgttggtcgcttgtgtttcttcttttgagaaatacccgttcatgtcctttgctcagttttgaatggggttgtttgttgcatcttgagttgttttgggttctttgtagattgtgcatattagtcctttgtcagaggtataatttgtaaacaggttctcccattctgtaggttgtctgtttattctgctggttacttcatttgctatgcagaagctttttagtttaaattttatttgtctatttttggtttagttagatttgcttttggagtctttgtcataaattatttgcttaggccaatgtctagacaatattttcctaggttttcttctaatatttttatagtttcaggtcctacatttaggtgtttaatccatcttgaattaatttttgtatatggtgggtgagagataggtgtccagcttcattcttctgcatatggctagccagttttcacagaaccatttattgaataggatgtcctttcccaattgtttatttttgttgacattatcaaagatcagttggttatagacagtggttttatttctgggttctctattctattccattgacctatgtgtctgtttttttttttttttttttttttttttttttttttaccaatactgtggtgtttggttataataaacttgtagtataatttgaaatcaggcaatgcaatgtctccagaattgttcttttaacttaggaatgctttggttattcaggctttttttttttcctggttcttttttttctgctatgaacttgaaaattgttttttcaaattctgagaaaaatgatgttggtaatttgtcagaaattatattgaatctagaggttgctttgggtaatgtggttattttaatgatattgattcttccaatcaatgaacattgggtatttttccatttatttgtgtcattcataatttatttcatcagtgatttgtagttcttcttgtagagatattccatttccttggttaaatgtatttctaggtattttgtgtgtgtgcatgtgtgtgtgtgtctactgtaaaagggatcaagttcttgatttggttttcaccttgaatgctattggtgtacagaagtgctactgatttttgtttgctgattttgtatcttgagactttctgtatcttgaggtctgtgagtcttctaaagaggtctttagggttttctaggtatataattatgttattagtgaatagagaactttgacttcctctttacaatttggattccttttatttctttctcctgcctgattgctctggctaggacttccattattatgttaaataggagtggtgagagcaaacataattgtcttgttctaattcttagaggaaatgctttcaactgttcctcattcagtatgacattggttatgggtttgaaatatatggctgttactattttgaggtgttttatgtacagctagtttgttgagggtttttaatcatgaaggcatgtttaatcttattaaatgctttttctgcatctaattgagataaccatatggtttttgttctcagcattgtttatatagtggacaatgttaattgatttgcatttgctgaaccatccttgcatccctggaataaagacctctttatcatgctgaattgtctttttgatgtactgttggattcagtttgctagtattttgtggaagatttttgcatctatgttcatcagggttattggcctgtagttgtctttttttgttgttgtgtccttgcctgattttactattagggttatactggattcatagaatgagttaggaaaggatctctcctcttcaatttcttagaaatagtttgagtaagattggcaccagctcttcttcatacacctggtaaaattcagctgtgaatctatctggtcctgggcattttttgttgggagatttttctactactgattcaatgttcttcttcattattggtttgttcagggtttctattaatatttccacctggttcaattttgggagtttgtgtgtttccagaaatttatccattttccctaagttttctagtttgtgtgaatagagatgttcatagtagtctctgatgatgtttcatatttctttggtatcagttgtcatgtcaccttatttttctgttgggacaagtcccatgactctctcctttttttccctcttattttcacctctatcaatgttttctttatttaccttatttttaaataacctttaaattttttccaccttcttgggatgagtcctttgattctctgctctatccttcactcttctcttgttaattagcctaatgtttttattaatatttgtaagatctgtgaggtgactctgaggccataaatttgacaatgcttctggaactgctacttgattctgcaggaatcaaatacttatctgtgattgttcagtagtgagctgtttgtcctgagtcaacgcaaacatgttcttctactgtgcagcataaaaaactaaagacactgctgccaaattagttactcacaacccattttagtaaaggtttctcaggaagctgatgataccaatctaaagaatggaacaattcgcttaaactataccttctgatttcaatggttacttggttttgcccttctcctacatttactaccttcttagtaaccacaggtctcagaggtagtttctgttgtctctgtataattctgcccttcaggggttgtctctgagtctagctcagaaagactcatatctgagcatggtccagtcttaaggcttgacccagcactctcttttaatttcattgtaactgttatagataacaataaccaaggaattaaacatttcacttttttattagtttgcatttcctcatgcatccaatgaacggactccttgggagtcagatttatctctaaattccatggatagcttttaactttagtaactgaactaaagcacagttgttgtttcataccatgggtgaccacatggccacccaggaatttgaggttttttattccctacccttatatgcattctttccccagcccatatgtttccttgaccgtgggccagtccagcaaatccaacttcactgacaccaactgggtaggggaaaactatctcaacccatgtttgcctccactctcacacaactataaccatcatcaacacagaagacttatgtaaccaaaggtacggggctttcgtctcacacagcaagcaacacacacgtgttgggtgttccccaattcagttttgtcagtatttacctggaaatagtttctgatctcacaggtccccaaggatacctctgacattcccagataccagtagcaagcccagccagacctctgaaacttctaaccaaccagcttcatgttggggttcccatgacccctttgttaggttcaattaatttgatgtagtggttcacagaactcagggaaacacttatatttgctgtttcattacaaaggatattacaaaacatacagatgaagagatgcatagggtgtggtctgcaagaagagtcatggagcttccatgcttcctcaggtacaacaccctctagggacacccatgtgttcagctctctggaagatccatacatttatttaaaagcacttacaaataaaatataagttccaaatggcagagatggtgtcagtactattccctgttttacacctagtgtgtggcatggagcccagcatctatgggtactcaagaaaaacttgtaagatgtatgaattcaaagaaaatttcaaagatttgtgatatatcacttactgttacatgtttttgttttctcagtcaacatgtgctaaaagcatagccattatcctgagctggtctgtgaaactttacatatttaaaggagttttttatactttaaaagattgggcaccagtgtttatactacagaattagtaatgacttctagtattatgtgctagatcctctgtgttttaaactgggtgatatagtaatgaatgcttttggaaactagcccgagattgatggcttgtgtagagagaaattggagagttagatgagaaaaatggatccatattgatctattacacttctgaatgaagaattgataatactattacaatctaatgaaaagaaatacaattagaagaagccattctttaagaaagtcccttacttccaccaaaaggaactagaaggtaggaagacaacatagaaaaatcctgtagcaatgtaggcctaaggtttaaaacagactggattgggaggatggctagagaaatctgtgaataaagagataggtaagtgatatgttttagaatacaaaaacaagaccaagctaatatggaggaagaactggagtggcagaacagagaatatcccatgttttcaagtaggagatacattatatctttgaataaactgaggacagcatgttgttggagggagtaagatgatgaatttggttttggagctgtaaggatttgacagctatgtgactcacagaaatatttaacaggagttgtaaatacagtactgaaactcagataaagaacatctatggagatgttattacagttgttaaaggcacagttattaaagggaaaatgaagtgaagaaaatgaatgaattcttcaagaacatattccaattggaaattgccctggtagttttacatattagttaataagtaaaccactttttatttataatgtattcataaagttttagattataatagtggagtagtttattattcttttgatatttagaataactttttgatatcatgcatgatgatagttattttaatgtgtgtgatttgagaatatagtgatgaattataaatttaatgatccttttacatgaatttatgtaatcactgctgctagatacattagtaatagtttccatatgtttgagatatctataatggagtggattgtaaaatataaattgatgagtattttccagctttcctatttcagccaccaacactcctttcttagcaaatctatggggatactcttagtgccttaggaattatccgtagctgagaataataacttcacatctttttaggattctaagtctaaaagacagaaattataaactcattagcggatacatgtgaacaggaaaaaccagcatttctcttcctgtcaaacaagatatttgacccttcaactggagagaatcagtgtatgtgcattcttttcctttacccgatgaatctgggtggcttgaaaagaatgataatttccttgaaagtgtttatagaacaatggagttgtatcctatgtctcagacataatccatacaaaaagaacaagcttagagagccacagacaatttccaaaacttcaccgctattactaagcggcatggggggtattctctgaatttcctttgggttctatgcaggctggggaattgagagaaacagtgggtccttcccggaaggtcgcctgactacaaagaagagatgagcattaaaaagttgtactgtgggccataagcctgaagctaaagaaggaaatgtctcaatctcctaagactgtcacagccaggaagtcaaagggggctgaaccacagagggaagagaaagcaatcatgaaacatctgaaccgattggtaatagaatgcagttttactgtatgaaaaacaggacatgtaggcaaaaacaacttaagattagaacagtttgatgattttcctccttttaacctctttgtgggcattagttatgaagttatataattagctgcttttttttttttcttttcttccacctgctagggagtgatgataggtggcttttatctcgacagaaagtacacggagggaagaacataggcttggaggctgattcttctgggtattctctgctacagagagaggaagaagttgtggagtcactggcttctaatgaaagacagatcatgactggccatctacatacatgaggagggaaggaaaagtatcttactttttatattatagaatagttttcagaccttagctcaaaagagcctcacttttagaaactttttattattctagaatgatttcactctctttgaacaatctcacaggtcatctctggaaaagtgatcttatttggaaatacagtagcaatgcaacacgtttaatggtctctctgacatgacaaaaggcaaaggaaactgatcctattggatgtggcaagatctaggtcaatggtgaccttttagagaaacatttctgtagaaggcctggcaggagacaaattgcaagggaacaaagaagaaataagtgtgaaaagtagagaagaaatgactgaagatcaagaagagtgctcacaaaaaaataagtggtaagcaaaagggcaagagttagaaaggttaacctatataaaattcaggctaaaaaggagaaatacattgcttgaaaacaccagaggaagaaaagaaaattagttcctgaatttctgttgcatttaaactgcatatatatttaataagttcaggctttcatgcagagctgtgtcattagtattggaggggaaaaaagtccaactaatagttataatctattaatagggatgaagtaaatcatgtttgggtataattagtaagagaacatcaataaaggagaaaaattttttaaatctaatagacctagaataaatcacgcattacttgtaattaccaggaaaatacttggatcatggcaaatgatttgacaacatggttctgtttaatttaccaacctattttaaatggaaacataatgcttgcaatgtattttactgtctattcgttacacaagcacattgagataataatgagaataccatgagatagtaaagaactacttgttctcttgaagagttatgagaatagccaaaatgttcaaacttcacattaaattttatatcatgatgttaatttattttaaatttactctgtcattccaatgagaatggctttctctgccaaggtttctgcaagctgtcaattgtcccaatgctggctgttgatctcctaggcagatttgggccataacacagccctttgcacccagttactaggaataattgaaattcatcagttttccacattttgatttcattttcttggtaacttctctttcacagactctcattcccacatttttgcattactgctgaagtctggaaattagtcttcatcacattgttctttcattccctctttactcaaatgcctaattaatcttctttaagcatagcttaaatcattctactctctttttcaaaaatcagtagcacctctgaccttctattttgttagcctttagttgaatttttattttgctcttttctgggagatgaaatattttattttgtcactctactcctaaagtgagtttatatgtcttactagtgcataattcatctcacctgatacacttttaacttatttatatgttgaaagtaaatgcattatataactatttgggccaaactctgttttaggtcccagtaatatgaaggtggatatgcagttgagggaaaaaaaagacaaaaatacacagcatttgcctttgaagagaccaccagtttgttatggcagcagatgataaaaccagtgattccaaaatagaattgagaaaaaaacgagagtacagacaggaaaggataatgtttcagaaaattttcagtggtaggtggggtgctaggtaaaggtgagtcaccaggaggtgtaccaggtgtgttgtatagcacaacaaaactgccatacaatatagtatattcagaaaactaattacagtagttcaataatactaattcatgagaaaccagataggttatctagtgagctgatgagaggtcctcacagagtttaaacagggaagtaccatggtaaaatttgcaatttaaaaacatcattttggaagcaatgtggtagatgggtttgagttgaatgaaccaaagtcaagttaactaggtagagagctatcacagcaatgtggaaaaggaataatgtggttctggacaaagggagtgtcagcatgaacagagttaaggagacagatataagtgacagctcaaagactttaaaaacaaatatactttatatttcatagtaattttaggtttacagaaaagttgaacagaaagtatagagggttctatatgctttcttaaatgctgcctgagtttctcctattattaacatcttgaattaatgtggtatatttgttacaattaatgaaccaaaattgatacattattaactacagtcaatagtttacatcgggtttcagtctttgtattattcaattttatggaatgtagagaaacaaaaatgcacaatataatatgtgaaccattacagttacagtattgtacagaatagttttcctgccctaaatatctactattttttttcattcatctctcctctcctcccaccaccaccctaaatctcaggcaaccactgatctttttactgtttctatagtttttctttttcaaggttgtcatatagtgggaatcatataatatacagcttttacagatggccttctttcacttcgtaatatgattctaagtttcctccatgtctttttatggctcggtagctcatttcttgtcatttttaaataatattctgttggctggatacaccacagtttatctccaaccattgaagaatatcttggttgcttccaagttttgacaattatgaataaagctgctataaacatttgtgtgaaggtttttgtatggacataaaagtatttttaaactcacctggacaaagatcaaagaatgaatgctgaatcatttgctaagggttttatttcactttgtaagaaactgtcaaactgtcttccaaagtggctggtatgaatttgcattcccttcagcaatgactgagagttcttgtagctccacaacctctccagcatttcgtgtcagtgttctggattctagccattctagtaggtgtgtagtattgccttgttgttttaatttgtagctctgtaatgacagataacgttgagtatcttttcttatgcttatttgccacatgaatgtctttagtgagttgtctgttgagagtttttcacactttttagttgtatttttattgttgcattttaagaattgtttgtatggcttagataaaagtcttatcacatatgtgttttgcaaatattttctctcagtctgtagcttatctttccttaattttaagtttctttctcagagtagaagtttttcattttaataaaaatcaacttattaattttttctttcacggattgtccttttagtgttgcatctaaaaactgattgccaacacaaaaatgtgaatatatttaatgctataaaattgtattcttaaaatagttaaaatagggctaggtgcactttgggagatcaaggtgggcagatcacttgaagtcaggagtttgacaccagtctggccaatatggtgagactccatctctaccaaaaactagagaaattaggcagagtggtggggcgtgcctgtagtcccacagctgtttgggaggctgaggccggagaatcgcttgaacctgggagacctaggttgcagtgagcttagatcatgccactgcgctccagcctaggtgacagagtgggactctatctcaaaaaaaaaaaaaaaaaagttaaaatggcaacacttttatgtcatatacattttacaatggacagactacacaaaaactcattgccaaactgaagatcacatagattttctcctaagctatcttataaaactttaatagtcttagatatgacatctaggtctatgatttattttgagataatttttgtgaaaggcataaaggtcagtggctaggttcattttcttgcatgtggatgcccaattattcctctaccatttgttgaaaaggctgtcttttccccactgaatatcctttgctcctttgtcaaaaataagtggaccttatttatttgagtctatttctgggctctctattttgttcaattgatctatttgtctgttcttttgccattaccacattgtcttgattactgtacctttatagtaagtcttgaaattggtttttgtcagtcttccaactttcttctttttatgtaattttgtgtttgctattttgggatttttgccttttcatacaagctctagaatcagtttgtcaataaacacaaagtaatttgctgggattttgattggaattgtgttaaatctatagatcaagttgggaagaattgacatcttaataatattgaggctgcatagtgcttattttaagtaaagagtgaagagagaggaattagggattacttctatacctcaaattaggacaactaggtgcgtcttgaccctcagttgggtataaacggaggtacagattttgaagtgatgatgataaattagatgttagatatttagaatttgaattgccaaagggcaaccagatagatataatcaccatgcaattgaataatcagatatggaatacaggggcctggcctggatataaagatttaaaaatcttcaacatacatataatttattgcttatggagaaaatagatgtgggggagaatatgtgagaagatgttaggaaatataaaaatgttcagtgtgaatatagaagaagttgccctggaaggaactatagtgaaaatgtcagaggtgaaataaaataaaacaatccacagcagatgaggttgttttggaagccacatgagaaaatgattccaaaaggaacttgtcagtatgccaaattaacatagcatgaagatagtttgttcactatatctgtgtgatgggatcatcgtacaacgggcctcaatggcatgcaatttacccatgtaataaacctgcacatgtaataaacctgaacctaaaataaaagtcataaaagaagaaaaaaatagcataaagagtgaaagcgcaaggggaaaccaaatttcatggacatgaaataatggagacacaagtatgaataactcttataaaacaaatgcttaacttgagagaaggatcaatataattaaaggaggatgataaaaggactagggagggtattttgtaatcatctcacgctcattttcatcattaccatcattgccatcagtctcattatttagctgggacaaattggtgtatatttatatattgagggcaaataactagttcaaaattgaaaggtaaaaaacaggccaggcgctgtggctcatacctgtaatcccagcactttgggaggccaaggcgggcagatcatgaggtcaggagattgagaccatcctggccaacatagtgaaacctcgtctctactaaaaatacaaaaattagccggacatggtggcatgcctgtaatcctagctattcaggaggctgaggcacgagaatcgcttgaaccaaggaggcagaggttgtagtcagccgagatcgtgccactgcactccagccataaaaaaaaaaaagggaacacattttcccaaagtaattaaaaggaatttccttccagggataggtgcaagaattaagcttaaactggacaagacacttttctctcaagcaattaataagtaaacagaagtggttgaagaatgagaacaagcttgatgtttaaaccttagccaaaaaataaagaaaaaaatataaattattagtatctaataatcacttggatactaatcatttgattattggacactagtaaaagttaattaaaagtaaattaactaataaatgttaatcaaaatatttctcctctcaacctgaataaatgttcaagaaaatatttaacttacttccaatatgttttacttcaaaatttagctttggcatattggatataaagtgtggaaattttcaactccttctccctaaaatcatgcaaaatatgcaaatgaaattgagccatggttcaatgaagcaattcaccaggctctttgtcattactgagaataatgacaatgcagagatgtcagacattgcagcacatttgaatctcccagtatactttgtacaaatctcacatagatggatgaataagacatgaagtttagatatgggtttgctccttgaatgatatctggtgccactagtttcaatctttcttattgatgctctttttgcattgctctttgtcagtcaggattcactcatagagaatttaatgcaggtaattgattacacagatgtgaaaaggcctgaaaaaacagaatagaggaaaaagaaacattccagattttaactgcataatcattcttaaggctgagggaagaatagtaggctatggggtcaccagtgcttagaatcatggagggttgagccagtgctgaaaccaggaaaggtaaattcatgaaggtgttgggaacttcgagagggtctgagcactgatggtaggctaagataaatgttctgtgttgtagctactagaactgcaaaaaacaaaaacaaaaactattaaacatttagctttacacgtttatagagaccataaccaagtattttttttctgtcttcctgctttcctttttcctatgagttcctctaatggaagaaacttaactagaagtcagctggccaaggaatgtggaaaacatagttaacagggccctaactcccttaaaatgcataatagaacatagagggatagaagagggaatcaaggtcaagcacatttatgattggcaaaatgaactctccacctggagcattgtttgacaagattcccgaatgaaagagggttttaaatgaaaataaccattacctctgtcatccactcaacagtatatttgaattcaagacattccaaacatgggccagaagacctaatttttaatgagagctttactcttaacaggaaaataaggaaaacatctacaacaagtgtatactcaggaggattcacagagactgtattttgaactggctcattgtttggtgtcctgaaggttttcccaccccagggagatgcatcctattaagacaacacatagatgagattacagcagtattgggtacagtaggagacagggtcatacagtggagaagagtaagacatcttgagcccagatgtatttttaggcacatacatttaggaaagataatggatggaagttgatgatctaaaaattggtttctataaaaataccacaatcctgtacctcttggaaagtcttatgaacttctctatgtatacttcaccttgaaaactgctcttatagatgattaagaaattgtgtatatttaaataataataaagctctaaaaggttgtgcaatgaactttagtatgaaatgatagttctttgtagtttttagcctattgcaaacatattcaatttctgaagggagaatcaagattttgcctctttaaagtcaagtcaacattattactgagcattaattaatcacgtatttaaaggtcaacaggtttttttgtttttttttttcttttttttgacaagagtctcactccagttgcccagactggagcagtggcgtgatcttggcttactgcagcttcgacctcccgggctcagatgattctcccacctcagcctcctgagtagctgggactacaggcacatgccaccatgcccagttattattttttttttttgtatttttagtaaaaacagtgtttcgccatgttccccaagctggtcttgaactcctggattcaggcgatccacccacctaggcctcccagagtcctgggattacaggcatgagccaccgtgccaagccacggtttttgtttttttaattgaaacagaaagtaaagaccgtgattcttgaataaggtatttgtgatgtctatggttcaaaatgtttatgatttaagacaggtatggctattaaaacacatattactccttaaaaacttagaaaatacaaggttgttcaattataatagtattctgcatttcctgctccaaataaaaagactttgaaagagtgggtctccatttctatatttgtcccttagaacctcagacagcgtgttttgagtcttcatgaaccctgtgagaaagtaactaacctacaactatttcttgcatagctttgaaatataataaatcaattggacctaaaatccattttaaaggttcaaatattaagctttagttataaaattataaagcctttctcaacaaatagtctggtttgtagtgtagagactccattttcataaagattagtgatatatacccatagtctttacttctaatttatttaccagcgtatttccttatctgtccttcctctagcaactacatttcggcataattattgagagatattttttacacgaattttaaattacctagattccactagagtgctatatagtaagttgaataatggcaccagagatataaagcctattgtccagaacatgtaaatattactttatgtggcaaatatattgcagatatgattaagaattttgagactgagatgttatcctgattatctgagtggccttaaatgcaatcacatgtatatttataagagggcggaagaggcagctttgaccacacagagaaggcaacaggagaaaatagaactgagagaggtttgaagatacgaaccttgaaaattggatgatgtgccagatgataaaccaaagaattctagtagccattacaagctggaagaggcaaaggacacattctccactagagcttctaaaaggagtgtggtccctttgataagtcaattttggccaagtgatactgttttagacttctggcctccagaaatatgacagaataaatttttgttgttttaagccaccaagttttggtaatctgttacagcagtcataggaatctaatataggtaccatgcatcatgtatacagaaaactatagtagcaactgggttaagttaagccaatataattctcatatgtctcttccaaattcagtattaaccaataagaaaattttccttctaagtttctattattcttataaaaacctgcattctgtgttgctatgcttacttaccataattgattaactctctggttgtacttttgaaagactatatccaatcactaatcaaaaagcagccattactcagtatgatacccagttggatgagttcaagtaatttgctcaatggggagaaatctcaaacggtttaaattgtgatgcctttttagccataatgttgatgctatattgactaaattgtaattatattatacttgtgctatttttggcagtgagaaaattttttattcaaattatcatactcattacatatgtaactattgaaaaataagttttgaaggcttgtaatcatgttgctttatttcatagctggcatataaatgtaaaaccacactttgaaactttaaaactattccagaaaagtttttacattttgagtttggtaacattttgttaagattgatcgtgaatacttagtctttttttcaactactgttaaaaaatgatggaaaatgtatcatttgttagcagacttttgaaagtcctgtaggcttgacatacaaaagcatgaattattttgtatctgtaagaaggtttctacatttgagagcagcaaagcacaatcaaggaacagctaatcttagaccagaaagaaactggatgaaccttctttcacatcctgaaaactaactgactttttttgaagatcaaactttttgaataccaacttatgctaaactcataatcttacaattgttttacgacataattattcatattcccattttaaagttaaaataactaagtctcagagtagttaaatatcgcctccttggagtactaagtcggaattaggtaaccaggtctgcctatgtcttttctgtctccatgcagcactatcttaagtaatatagccactttatcaattagtgagataatctccatagtttctaggcactttaactttatttacacataagaaattaaattttgaataccaacacctctttcaaaatccatcttcttttagaaatgacagggaaaatgtcattcaacagacagtaaaacagtgcccagtgtagattaaataaaaacaaaatgttctgttctgagttttgcaatgtggtataatgagtttttcacaagaaaaaaaaatggccgtaataagaagtgcccccggctctcatacttttaatgttattaaattaagttcctttgaccttaccttgaaaattccattccaaagcacactaacaagctatttgttactttttaattatttcaattgttatctgaaatgtgagcaaggttaaaaattttttgtgggaaagtattaaaacttcgagttctcattaagaactgcaaaatttgtcctttcagtcttctgaccaacattctccattcattactgtagagtttccctctgaaagaggactacagagataagatgaggtcagtgataatggcgatgatgatggtgatgatgatgacaaatctgacattaaagaaagttcaactgtggcgaattctattgtgcatttccagtcacctctaggtcaaagtcagatttttttcatcatatatacttttttgatcttataagccaattgtatcagttaattcatcatcattagactgagtttaatgaaagagtaagggtataacattttgagtgcttattatgttttaagcactgggctagccccttgacctacctgacctcaaatggccactgtcatctttagtatcattaatggtggttttctgcccttgctgcatgtcaggcttatcaagggacattaaaaattattgatggcttaggctctatgacagaaaaattacaacagaacatttcaaaaggtcagttacagccatcagtattttttaaaaattaaattaaaatttgaagccaagggaaaggaagtatcatcaccttcaagataaaaatgttattccctcttatctctatttggccagtttagaaagttcagggagactttcttcactaaactacctttccagcaaaaaataaccctatgaagtatgagatattgaaatattaatttgctttgcttttctccgttcttcctcatagtcaaaataaatcaataattataaaattattcacccaaggactcttgcctctgagtctgatatgcttttgtatgtcttttctgtactaaatttactgtttccttttataagtcaaaagcatgtgtctggtctagggaattcaagtgaagagaattcaaaattagaatgaggaacataaaacatagcacctggctgtgcccagttacttaaatcaagcaagctaataactcaggtagaaccaactagccttgtttgataatcctggcatggaaagttactaagacataaaaatcaattaaaaatacataattaaaaaaatacgtgttttaaatgagtttctatattgtttgtttgtttatctaacatgctcatatggatagcaaggtttattcccaagtgggttgagttcctttgacttgtgtagcacctttttttatctaaatatttttttttttaatggagcagacatagagttactagaaaaattcagctaatgctcttcacagaagaagcacagaagagatctcacaaacagaaaatcagccatcataaaatgatactgtcaggggcacctttatcacctttatctatccatttaaaaatgaagacttaaaactgaagtctacacacttacctgtaatcccagctacttggtaggccgaggcaggagaattgcttgcttgaacctaggaggcagaggttgcagtgagcggagatcgcaccactgcactccagcctgggcaaccgagcaagaactccatctaaaaaacaaagaaagaaaaccaaaccaaaccaaaacaaaacaaagcagaaaacacacttaccaaagatttctaaaaaattaaaaatctggccgggtgcggtggctcacgcgtgtaatcccaacactctgagaggccgaggcgggcagatcacgaggtcaggacatcgagaccatcctggctaacatggtgaaaccccgtctctactaaaaatacaaaaaaattagccgggcgtggtggtgggtgcctgtagtcccagctcctcaggaggctgaggcaggagaatggcgtgaacccgggaggcggagcttgcagtgagtggagatcgcgccactgcactccagcctgggcgacagagcgagactccgcctcaaaaaaaaaaaaaaaaattaaaaatccaaaaatctacttttagtcgtcagcaccttatgtccaatgaattggtttttagttttattgtttttaatttccattttgtttgtgtggcagaagatactactttttaattacacttcaaatagtttgcaaaagaaaataatagtagcagtaatgattattatgtaaaagtgggcttttcaatagaggtagacgttcaaatatgttaatgaccaacatgctgagacagatacttgagaagctacattgctttatccaacaaaaatatagccactatttctgtgacacctactgtccaagacattttgcatatattaaacgacttagtcatcataaaatgtgctccttatttccattttgtaaggatgataaacgaaatccagagaggttaacgaactgcctgagaggtagaccaggtgattccccacctgtgtcacaccccacaccagcaggctttttgctcctcaaggctttatgacacattggtagagagctcattgctgtctggctagatcaactatttgcttatttgtttaggagtcatgaaatcctctttgactttctattgggttggaactatatataagactaatgtatttcctacaattttacctgggaataaatatattctataaagactgtatgtgagttgttaagatgtctctagtatggtgaaatacctagcatatttgacagctcatttttaacatttttctctataatacaaaattattttcattaatagccatggaataaaataaatgataataatggccataaaaataatacaaacagttaaaaaattattgaacttttatgtataatctgccagaaaaatacctacaataaatgatatagtatgaaaaagaaagtaacatgttaatacttttaaattacattaatgtattggactaaactaagtattagttatcatagtaatggattaaaatattgacatttctgtttcttgttttagcttctgcaaatttctatacttttaattaataaagaatctaaagatttacccagaggtatagaattaaagtaaatcaagcccttcctttattttggtaattgtgttattagtgtttatttctaatttatcatttaaatgcagaaccaggtggtaccacagaggcacaaaatgcacagaaaaaatcgggacaaaatattatgaacttaccctaaagacaatttttgtgtagctgggtctgtgagtgttggatatcagctgtgtaggcaatagttatttgaattaacttccatgtactatacagtgtttattagaagattagtaaaaatgtgctaatttaaaatttatgtgcctatatatgtatataagtatatgtatatattaattatgctatatgttaaattatgtgtaaagtaatatatatattaaactacttatttatatagttaaaatacaatagtaaccacagcagttttttagaactgtcctgtctgatatgacagccattggccacatgtagctacttatactaaacttaaatttgtcaatatttaaagaaactcaagaatattaaaacttacttaaagaaaataaaatttcaattcttcagtcacattagccatgtttcacatgctacatagctcatgtggctagtaactactgtatatgacctcatagatacagaacatttccattactgcagaaagttggttgggctgcattgatttagaatttatatcgtccaaagattttcttgattagaaatactttattactaacgttgtttagaattaccagtgggagaagatgaaaaatcaaactgacttttagtaggtattattattacataacatttgtctacaggcagtgcaacccttattcctttcaatgggggccatccattcccaccaccttgtcctgcggttgctgttgctccagtgacccattaatgcttctatggctttcacattcttgtagacaactggtgccttgccacttaatcagaccttatgcagagtattattggtgtggttttgatgccaagttgttctacttcctcagaggacacaccccatcaatcattctccatcttttctctctttactgtcaattcaccatgaatcgaagcaagctgtgtcttaccttcatacaaatttacattattgtgccttggtttattttctctgtctagtcaactttgaaccattttcatatcctacttttctgaaattgaattttatgattctgtttgcctcccagtcattcctagtttcattataatctgccttccgcctaatctgtcctggctattgccatcccaatctctacaagaactcatccctgaccgaaccctatggactgagccctgacaccatgatcccgtggtgtctataaaacttgtcacggtatacttgaaaggtggatttgtttgtctcttatgggcaggacaatgtaaactcctagaatatgtaagtaattctgagccccaggaccaagttcagcttttttttttttttaatgtagagatcactaagcaaatatttgtagaaggaagggaagaagggagggaattttgatattattttgaataacctagttgtgaactcaagtagggggcaagaagacaagcaattaaaataaagaccatgcatgtctgctatcctcaagactatggagtcctcaagatgatatactatgatggcaagcaaattactctgcatttgtgaagatgcacctcctccaatgatcagatgtattacagatgcatcagtgatacactgtaaatcgataccttgaaattgtccatggctctattcatttaatgtaagaagtataatgaagggtttgctttatgctaagcattgtgctagaaactgaggatagcaagatgactaagacatttcacctgcccttaagaggtaaatttatttgttaggaacaagacacaaatatttaaaataattatgatgataatgatagttaatgttcatttagttctcctaattttccagcactaaatgcttctcatatattttactatataatttacttaacagcatataagtattaatgttattacccttttataggtgaggaaactgagacagagaggatgagtaaattgccaaagataatacaagtagtaattggtttagttggaattgtatccaggtagcctggaaacttggaatatttgtaaggatttataagactccatggaatatatttatataagactttcattttaacccaaatatacgatgtggcaagagaaggagtgtacaggcaagcatgggaagtctgaaacacaacaaagtgcaaactcctcccaggttcttagtcacacatggatggactttgcctccagaaggaaccacgttgaattgtgccataactcttggctccaagtgaactcaaggtagaagttaccaggaggatatgtcatgtccctctggcttctggtcaagctggactgtctaacaggttatgctgggtgcaaagcatcagtaaacaaacttgtactgcagttagctagggagttctggactttaaacagcacatcataaatcccactattcttatcttgaaaaagattcaaagccagtcatccaggcatctccagaaataagaaacaataattctcagtctagctttgtatttactctatcctacgcagaagagctaatcatggtgatggggatacaagggagaaaagtttgggaaaaagcatactgatgatccatgagtgaaagcatatacaaaactgcagaaacaaaggctgttttcctagtgctctgctgggacaaggggtggacttgaaatgacattaattactctaagccagtaaatgtgttcagcacttcaggtatgtaatatttatccacataacaaccccatgaaatcagtttcccttcatttataactgagaacattgaggcttagtgagaagaagtaattcgtcaaaacttagatgaagagaaaatagagaagcgctatcaccctgtctcaaaaataggtgattatgatttttgcaatgttgtctgcaggtaaatgtggaaagaattgaagggttgtaggtaaaggtcaatagagacttgtggttttatttatggccaaatgcagtagaggatcttgttggtgactaatagaattttttttttcagttcttgataactttaaagaccttgatgaaaatattgggagtagtctcaggtcagaaagacttgttctcattcaagagtccatcctctttttgtctatcaggaaatgccaggactggctggatagcgttatgttttttattgctctcataccaatgtttagcatgtgattgaccgtcactctcctgaagaaaaggactttggagacaattgttgtttttttttttttttagttttatcaagctgtatttaattttggtgtgtcaatatgacagatgtcaaggaaacttcttggctttttttcttaatctcttcagcttaagggggtgtctggcagcctgattttggtgatgagctggctgtcacagctgtaagtagcgccaaggagaatagataaaaagatttttgaaacttaagggtatattggtagaattattgtgaacagaagcagtccattttctgaagtggtttcatgaatatactctatcatgaagatatagatattgatatgaatgtatatatattatatatctatgtgtatatgtgaatatatgtaaaatgatcaaaataatttatgcctggactaactttcaaacttcttatttttattatttttcttaatctcatatctcaaagaaaccaatttctaccaattcttgctttcattaaaaaaattctaacagtcttagccataattgattactattgtccattcataagcattccattaaaaaagaaagaaaccaggctgtgggttttaatttaaattttcttagcttaacaaataaaatttaaaaattgagtaaattgttcttcgaatgcttaaaaagtaagtttttattatttccaatgtaatgggtgctacttcttccttcagtatcttagcgtgtttggtacagaacagaatgagttaacaacagtagcctgtctatgcctcctttgttcaagtgactgcaactaactgcaaattttagaggtccatgttgaaactccaataatctaaaataatttaaaatgaataatacataatatttatgaaaaaataaaatgcattttatgccagatatatattttaatgcatgtcggctacatgctcaagactgtagggcactcaagaagatacactatgatggcaagcacattactctgcctgtgtcaaggttccccctgatgatcagatatattacagatgcatcagtgatgtattgtaaatcaatatcttcagattgtccatggcaattcaactgatttgagtttctggcaaaaaatgacttgactaacatattggtattctggtttcatgaaatgttaatggattttttttttaagaaaatgaatttcttggagggaattgagtaacttgacatttcagcttttttaacatattagtgtacaatatgacagttttcttgatgaatatcaaagagaacagtgctgtatactgggttttcccaatatatttttggaataaaggtatttctcaaatctctctttaggaggaaattcttgatggctgagtaaaccacagccatgggagaaatactgaattacaccgtcttgagactactgggaagtgaagctaacaatattttgggttaaaatcaatctccaatcaatacacaaagaaatccccacacacattgtggagtctctgctttattaataatctctactgtcttacaaataatatactttggaacttcttcatgacaaaaacttagaatgtccatcaagagaatatcattaattattgaaaaagaagtaccagaattttacctctcattattagaaatttttcttctgctttctgcagatttttgaattatggtatttgtgtgtgtgtgtgtggtggcccttttatttttggaacacataagactaattcacatccttttatagattcggagtacggagattctttatttatcaaccttttctgaaactaagctatttctcttctttaaattatacactgtgtgatccacatgaagatttgtaggccataaaagcatcattagtatactgagatggtaacatgataaatagatctcacacagatagatttaacttttgcaactcagatctctcacaggaaaatggtacctgctctgcctacctcacagggatgccagaaaacaaacatgaaaataatgcaatatgtgtgaaaatcttttgtaaattgcaaagcagcctacaaagacaaagaactttaataatgataatgatcatgactcccaactgtacctgatcatttctggaaaatagaacagcttataagttagccaaagacaaacatcctctggctcaaatagagattgtgtcaaagaatatgtttcctttaaaacataattcattttaggaaaacactagaggagaaaaataaatatcgatattgatgttcaagatatttctaaaaattcagaaatcagctctttaagaatctatgaatacaaaaagaattgagatgagtaatctttgtttgtttgtttttggtctgtttttcaactatttttcttcttataacattggaagagcacaaatcccaaaacggtatttttttgaacgttattgtgttgtccaaggcagagttatcttaagtgaaaaatctctgaagcagtaaagaaaatatactgaaagtgcctcaatgatcagaatgttttcttcttgagaaagttatatagtacttttaaaagtacaggtcagagtatgtctttgcactcaattttgatttttatataaaatcctagatgtttctaccacagctggatctctaaggaagtagttaagaaaagaaaaatgtaagcgcagataacatatagttctttttagtcccataggaagccatagtgtcatgttactgaataaaatattttgaggttcacacaattcacatataaatctgtcttaaatataattaatatatttaatatttttcaaaataaacatgacggtattaggtttgccattaagtaatggcaaaacagcaattacttttgcaccaacctaatactttctgatgataaattcagacaataaaaaaggtaaaagattatttaaaatccatttgtatctgtaagtatgtataattattattttcatataaaaacttcaggatttttttctaccatttttgatcagttttactttagaaaaatgaaataatactgtgcataatcttttataacttgtttggcactgaagtacttttgtaggtatttttgtgaacatcataattatgcagcatagtatttagtatgtatatccaattctattgtaattaatagtgtaatttttaataaattccttttgggcgtttgaatgttttgattttttttagtataaaatctaattggtgaacattgttaaactaacatctttgtactttagacaattatttatttgggttaaagtcctagacatgtagttgttaagcaatattaaaattgaacacatataaaattgtatacttattgctggatcttcattaataaattgtagcaatttctccccaatgaaagctagatttaaccatttcacaatgtatatatactttaaaacatagtattgtacacaattagttatatagaattttatgtgccaatttaaaataaatacattaatttgaaaagtatgtgagaatggcctttagcccatccttttatcattatgaaagtgttaacaagaatgtttttttctttcccagtcagatgcagaaaatgtgaaatctcattagctcagtctgcatttattttattaataatgaggttgaacatctttttatgtttatcagccattcttttgctgtgtgtgaaatatgttaatttctattttttctctttttcatgttaatttgctcatatttttctaatggatattaacacataactagtttaacatattttctcatctctctgttttttctacttctctgtgtaactaaatcactatctttgcatttcattaaaaatcaaatactctttttattctgtaaatgacaggaatccctaagggagtgagaaccagctctgtaaaagagaccctgatacacgtaaaatgagaccctagttgtatcatgtctgtggctaagtgcctcatgccaaggtgaaagcattcacgttcatgtttggttgagtgtttctgagagtgtggtcttagccctccttgcagcagaattcattgtgctgactgctccacaatagattcctgttccctctgtatccttgttatttccagggacaggcctagaacctgcatttaataattaggtatttcttatacctgctaaagtttgataacctgtaagttgaataattcttgggtattaatccctagataaattcaggacatcatttgaagactattttttacgttcagtgccccctcctccatgaatggatcattatggaaagagatccaccttatatattcaatacattaaaacatttaagtaattcaataaagtgatattattgttttgttagatgagaataatatatcatcatatttcccttgtcagtatggcttccagtaagtccaaaattaaaatcaatgctcagtttaagaaatctcattgatttacatttctttaaaccacaaagtacaacaaaacatttgggaagccaggaagaaatgaaaataaatgtgcacttcccaagcaacctaacataacaggatattaaaatgggctcctctctttctagctggactaaggcttccaagattgagaacaatacagtagttctcagagtcttagatgagtaatagctaacattttcagtgctcattacatgccaggcactctgctaagacctctaaatttattaacccctcaaatgatttgatgaggtagaatactattatttactattatttccattcacaaattagaatgttaggcatagagagtttcagtaacttcctcatggttattaagcagtctgctaggaaagctgggatttaaacacaggccactgggctccagagcacgtgctcttagctaccaatccatgctggatactttatatcctgggagattataaaattagtgccagtggcattagcccatgaagacaaaaatatatatttgggtgagtaagaagattcttaaggctaatgatgaggaattcattattcagagaagaattatattccctttaatttttcatggtaaaattgtgtgtagacttctccttcaccttaaataaggaagaagtttaaagtgaacctcttggaaactgtaatatatattcccagctgttggagggttatacagagattagtgtcaattttcaccaagagaaaatgaaacagaaaagactactggagtggttttcctggccacagagtgaagagggaggatctgcatcccaattgaaaggtggctgcgggtccctttatcttgcaggctgtatgagagagttatgtttggaagctgactgtggcccatttgccatcctaaaagggacttgctcctggagaatggctgaaacagaagttacccaggaaaggagtaggaagccagcttggaagaaagcagctttctgaaggagacattgaccatagtaagggaatagttatatggaagatgacctataggaaatgttccttagaaaccccagatgaaccccaagaaggaactagagagggggcatctgtcacatctgcctatgatgcaactgacaaccactccagctccatgaaactttgctcatcttcgtgaatcttctatttctccttgttctgacccctgaaggttagaaatagcatcatgaaggataaaaggggtgaaatgaatacgagagaagacacatctccaaatacagcattacgagactgggactggcccatgctgaggagaggggacgcctttaaagaatacattgaacatttttaataagaatgaatttgattccttcttttcattttaactagaaaacaaaatgactatttactttttcagaatgacaggaataactaagaaacatgaggtgatttttataccaaggtagagaagatcatccctacaaagcgtctagggggtgtcttattactaaagaaacaatcatctaagcagtcttatcccaatcttcctgtattttaggaactgaacgaccaaagtttatgaaattcttttattagttttgtgtaaaactggaatatagcttatacttttgaagaagtgttacatcagctacttttaaactcactcatttctattttctgtatagaagcaggggagcacatttcataagttgtcccttcttcagaatcttgtctgccctccttataaagggaagttcatgtatctgagatctttgatttgtgggaacataaaaatcaaattgactttatgcagcatttttatagagaattatgttttttgaaagcccaatatcaaagtctgctttgttctaatttaaaagataatcaaaatatcttcaacactatgggaagtctcccagtaaacatggatttatatttagcacaatttatttgaaaaccagaaagtctgccaaagtggtataaacattaacttattttgattttagaagacagatattagtgagaagtaataaaatattgccagccttcataggcaactcatcatcactgttaaaactaaataagaagaaaagacccagttatgcctaacatggaccgatgttggttgaaaggtagatagaccccataactggctagccacatttgaaggctataatcatagaagatgggtgaaggaaatgcacaacaccaaatttgcaacatagactcatttgacgaaggggaaaatatgggacattttaaggaaaatgtcagaggaaattgcttgatagtatgaactacttatgtgtgattcttaagaaaattgtctccttaggaaattgtgttctcaaaatgtcttaaataaaaatagacataactgaatattctatattgtggtcagacattagaaaacttgtttttacctgtcataactcctcattctcctgaggaagacttaggatttgtctgagtttgagggttctggagacgtactcaacctgtttcccattcaagcctgataacacgaatcttaggctaagaccccattaaaacctaattggataattttgtacatgaataactaaatgcaaattcaaatgcagatagcatatataaactgcataaaggcaaggtgatattacctatatgattattacatgcatataacaatctccacttattcactgagagtttattgaaataaactcaatactgttctcttcatgggaaggataaggaagtcctagctttcaatgtgctgaaaggcctgtagggaaaagaaaataacaggaatgagaacacacgcacacatacacacacacacacacacacacacacacacacacagtttgatgcaatgagtaattaagtgctacattatagaacacaagactataggtgttcagaaaaaaataaatcagtgagaactggaatactgcagaggaattttctgaaaacaaaacaaaacaaaacaaagacgctatcttgaagtgtgccttgaaaagtgagtaagttatagaaaaccagactggaagtgaggaaatttcaagaaagagaaataaaatcccacaggtccaatggaggaaatgacaaggaaactggactagggaagcagcatagcacagtggctacaaacagagtcaggagccagatttacctgagagtctcagctccactacctactgctgtgaccttaggtattatgtcatcattctgtacacacttccattgtcagtaaaatggaggtaaactatcatatcaattttttatgtgagcagttttgagaattaatgagttgatatatgtataaacttatgctaggactcagtacctagaaagcatccaacaatattgttattattgttgtgcaatggtagaagatgtaattgtcatggctagaatgaagccaaattatgtaacaatagcaaatgccacttgttatagactaactgagcaatagaccctaggctcaatgcttcgtgtacattttcttccttattcccaaccacagtgctgagagggaaacatcatttctctcactttagagaggaaggggctgagatttcaagaagcaattttcttaagaattccactgctggtaaaatacagccaaagatttgcagtcagatcttttggcctatgcaccagtgtttttatctgctgcattataatgccttaacctaaatctaagagggctctgagatttaggcagggggcgtgtatctcagaccgaaatttactggatgggtttgaagcagaaaagagttcatattctggaaaaccagccaggtggcagctggaggctgttggaatactctaggaagggaggtaaatgagcttcttgtctattggcagtgctgagacctgcaaaggcagaaccaggatgctagattggttcaccacaaatttttcacactaattttcaaataaaatttacactattttagtctgggccctgaagatgagacttcagttaagtatgactcttgtttgtagagcccacctgactaaggatatggttgcttctgaaaggccaacactgagaaagcctgcacaagggacctaggttcctttcacataaggccagggttaagagagtctggtgttagcccatatacttttcacagtgctggctgggtgcatctaccattgccttcatgagactggtaatgagctttcctgttaccttgtattgcatttcacttgccccatgggagctcatgttcacgttctctgagctgtgttccatacaaaagtcacttaagaaataacaaagttgtcctggaagacagtgattgctcctaatacagttgagaattctatgctttgtagccttagaccctttacaagcaaatagtagaaataaacgtcatggctaatgcacttcggtaatataaaaggtttctacaaggaaaatactgctaacagtaaactgtttatatatagaaaagataaatcataatggagtggtaatttcagtttattttgtatctcattgtgtctctccttggggaactccaagtgctctaaagacactatctcattactattttgagtacctctgaaaaatatgcagaaagcattttctccaatttttgtttaaggatctaagtcacggaatttatgcagcttttcagtggatgaaagtggattactccttttcacagagaggattgtttcagtgaatggctgattgtctggtaagattagtcacccaatttaagaaaaacaaaaaaagaacactgtccccaacaaaaacaaataagcaaacaaaaaataccctgttaatctatttcaatacatgttttggcaacattttgtagacttgtttgaacgtcataaatacagccaggaacagaatgtgtttttctgactttatctgctaagtaaccaaccacattgttaggtgaaagttgttgataagtaagatgaaatttttaagaaaaaaattaggagacttgaggtttccagataaatgtgtaaaacagtgggaatggagctgcttttttctgttttctgctatctcagtgaggccaaccctaatcaatgacatatcaacatccctaacagagcataatctctgcatccagaaacaatgaatgaagaatggtagatcacttccttagagtttctaaggaaattgtaacagagcctactaactctttcaggcatgtgactccctaaagcacctacctcttcatgcatagctggagggtttgatgttgctgcttctctgcccacctttcccacagcgttcctgcttccccaatttcctgccttgactcagttgaatagattcaggaattacttaagttgcagcatagttctggaagatgctagtgcttgtcttcttggttgatccttttgggtaaattctttgtagaacaacttaactcatctttattaccagatataataacccatattttattgctcttaattttatgtataaccaaacatcctgttttttttttaaccgtctttcaaagagaaaatgtttttgagctactatgtactgtgaatgctgatctctggctaataattaggaaaggtaatgtgcctgttatttttggtcagttttattgcattgaccttactcctttcaataaatatttcagtggtggaaaaagagatatttgaaccgtaaattctacattagtgttttgttaaatcgttctacataggcactagttttcagctacaaagtgattagaaaatattcgttgtatttggtcattaatgaactgtttcaaagcgaatcaagaccaagctcaagcatccatcaccatttcttttccatgactgacttacaatagaaatctacagatgttaatcaccaagatacttttcctgatttgtaaaacctgagaaagttgggcattctcttatggctgctttaatttgcatatttccatatagtgtaaagcctaacagaagccaagaaattgcttaattatttgctgatcttgaatacagcccaaatgttgcttgaaatgtctatgcaattgtcttctctgcatgatcacctactaagtctgctccatgactcctccttcacatctactgatagtcagattttcttctgtttgtatcaagatttcatgtgatttatcacatttttttactttaaaacattataattgagtaatatttgttttagcttatgtagctatttcctatcactttacaaaggtctttgttaggttgtaaatttttttaactacacaagccattagatgtgtacatactcttacatctttcttgttctttccataaaacgtgtcctatctgatgcacaaggatgatattaaggtgaaagctttttatcatctaattttcattttactttcacagtcagactggattttcaatatatttttgttataaaaaactattacatatctcttgtctactttaggcatcattccacctattcctgtataacaggaaatgcgaataggcctctcactagcttagatgatgttctataagagagaagacaagatcagttatttttatatttctaaacacatttgagactggttaaaagaatataaagctatcttttggcttaatattctttattgatagatcagataaagtagaaaactgagaaatagcaaaaatttatgtttttgaatttcttaaccttcaaaaatatttcaaaatttataaactttgaatttatttgtagcttgctaacatcatgtcctgaaaactaacaatatagctgtagatataatgttgattattagaatttataagatttttagtataacttcaaatattttaaatattcttctttgcttcctattgaagagaaagcaagctcaggcatgagtatctcttttagttgaagatctcttgcctgtttgtgttgtgtgcagcctaattaattccattgaaaagaatacttaccatattcactgtattcaggtaagaatgctatttctttgtgtgtgtatttttttgggggggtctcaatttctttactgtgataaaatatgaataatataacatttgttactttaataattgttgaatgtacaattcaatggcattaagttcattcacatttttgtgcatttatcactactctctatgtcaagaaatttttcatctttctaaactgaaactctggattcataatacaataattcccctgccacctttcccccagcttttaataagcactattctactttatctgtataacttgatgattctaggtgcttcacatcagtggaattctacaaatcatacaatcattttgtatctggcttatttcacttagcataatgttttcaagggtcatttttgttgtaggatgtatcagaattttttctttttaaggctgaattatatttgtgtgtgtgtgagtgtgtgtgtgtgtgtgtgtgtgtgtgtgcgcgcacgtgtgtgatgatttggctatgtccccaccgatatctcatcttgaattcccacaagttgtaggaggcactgggtgggaggtaattgaataattgggggaggtctttcctgtgctgttctcatgatagtgagtaagtctcatgagacatgatggctttgtgaggcagagcttccctgcaaaagctctctttttttttgcctggtaacaaccacgtaagaaatgacttgcccttccttgccttctaccatgattgtgaggctttcccaggcacatggaactataagtccaattaaacctctttctttctcaggtatgtctttatcagcagcatgaaaacagactaatacaataaattggtaccagtagagtggggtgttgttgaaaagatacacaaaaatatggaagatattatggaactgggtaacatgcaggggctggaacggtttggagtgctcagatgatgttaaggtgaaagctttttattatgtaattttcattttactttcacagtcagacttgattttcaatatatttttgttataaaaaagtattacatatctctgaaatttggaacttcctagagacttgtggaatggctttggcgaaaattctaatagttatatgaacaataaggtccaggctgaggtggtctcagatggagatgaggaatttgttgagaactggagttaaaggtgactcttgttatgttttagcaaagagactggcagcattttgtccctgccctagagatctgtggaactttgaaatttggagagatgatttagggtatctggtggaagaaatttttaagcagcaaagcatttaagaggtgacttgggtgctgttaaaggcattcagttttaaaagttttaaaagggtaacagagcataaaagtttggaaaatttgcagcctgacaatgtgatagaaaagaaaatcccattttctggtgagaaatttaagctggctgcagaaatgagcataaataatgagaagcctaatgttaatcaccaaggcaatggggaaaatgcctccagggcatgtcagaggtcttcagacaaggcagcacccctcatcacacaccgagaggcctagtagaaaagcatggttttatgggtcagaccatgagtccccaagctgtatgcattctagggacttggtgccctgtgtccaggctactctagccatgactaaaagggccaaggtacagctcaggccatggcttcagagggtgcaagcccgagccttggcagcttctatgtggtgttgagccttcaggtgcacagaagtaaaaaattgaggtttgggaacctctgcttagatttcagaggatgtatggaaacacctggacatccaggcagaagtttgctgtaggggcagggctttcatggagaatctctgctagggcagtgcagaagggaaatgtgggatcagagcccccgcacacagagtctttactggggcactgcctagtggagctgtgagaagagggccattgtcctccagacctcagaatggtagattcaccaacagcttgcaccgtgtgacctcttgcttcagcgtgacctggatgtgagatacggagtcaaaggagatcattttgcagctttacgatgtgaccgttgtatctaggaagtaacttacttgctttttatttacaggctcataagcagaagggacttgccatgtctcagatgagactttgtactgtagacttttgagttaatgctgaaatgagttaagacttcgggggactttggagttaatggtgaaatgagttaagactttgggggactgttgggaaggcatgattggttttaaaatgtgaggacatgagatttgggaggggctagagatgaaataatatggtttggctgtgcccccacccaaatctcatctccagttcccacatgttgtgggaggtactgatgggaggtaattgaatcatagggggaggtctttcccgtgctgttcttgtgatagtgaataagtctcatgagatctgatggctttataaggcagagtttctctgcacaagctctctttttttgcctgctgccattcatgtgagacatgacttactcttctttatcttccaccatgattgtgaggcttccccagccacatggaactataagtttaattaaatgtctttctcttgtaaattgcccagtctctggtatgtctttattagcagcgtgaaagtggactaatactgtgtgtgtgtgtgtctatatgtgtgcacgtgcacgcatgtgtgtgtatacaggcatacctcagagatattgcaggttttgctccagaccactacaataaagcaaattttgcaatacagtgagtcaaggaatttttttttgttctctcatgcatataaaagttatgtttacactatgctgtagtctattcaatgtgcaatagcatcatatctgaaaacaatgtaaatatcttttgaatactttattgcttaaaattgctaataattatatcagcattcagtaagtcataatctttttgctggttgcggctcttgccttgatattgatagctgctcattcatcagggtggtgggtgttaaaggttgtggtggctgtgtaaatttcttaaaataaaacaatgatgatctttgtcacatcagctgactcctcctttcacaaaagatttctctgtaacctgcaatgctgtttgatagcatttcatccacagcagaacacctttaaaaatggaatcaaccctttcaaaacctgccaccgccttattaactaaattgaggtaatattccaaatcctctgctgtcatttcatcaatgttcacagcatcttcaccaggaatagattacatctcaaaaaaaagaaaaaaaacactttctttgctcatccataaaaaaacactcctcatccattcaagttttgtcatgtgattgcagcaattcagtcatctcttcaggctccgcttgtagttctaattctcttgctgtgtccaccacatctgcagttacttcctctactgaaatcttgaactgctcaaagtcatccatgatggttagaatcaacttattctaaactcctattaatgtagatattttgatcttctcttatgaatcacacacgttcttgatagcatctagaatggtgaatcttttctggaaggtattcaatttaccttgctcacatccatcagaggaatgactatctgtagcaactatagccttacaaaatgtcttacttcaataataagacttgaaagtgcaaattactttttgatccatgagctgcagaatgaatgtttgtgttagtgggcatcaaatggcattaatcttgtagagatccaccagagaaacaggatgaccaaatatgctgtcaatgagcagaaatattatgaaataaatcttttttctgagtagaaaaaaaatcctggacttaaaatatataaaaccatgctgtaaaaagttgtgttgcattccaggatttgttcttccacatatagagcacaagcaaagcagatttaccataattcttagtggctctagcattttcggaatggtaaaggtgcattggcttcaacttataggtgctttagcctataacaagagaggcggcctgtcattgaaagctttagagccagattttgacttttactctctaactatgaaagtcctagtatttcttatctttatccaataaaaggcaatagaaggttccttatgctacattgaaaatgtgttgtttaatgtagtctatcaatgatcttaactagatctcctggattacttgctgtgcttctacattatcacttgctgcttcaccttgcaattttatgttatgtagatggctcctaatgaaccaacctctgctagctgctgacttttcttctgcagattccttacctccctcagccttcatagaattgaagtgagttatggccttgctctagattgggcttttgtttaagggaatgttgtggctggttgatcttcaatgtaaaactttcttgttatcagcaataggcttttttgcttttttgtcattcatgtgttcattgtaggagaacttttaattttcttcaataatttttttttacactaacagcttggctaagtgtttgataaagagacctggcattcaatctatgtcagctttcaatatgccttcttcaatgagcttaatcatttctagcttttgattaaaaatgagagaaatgcaactcttcttttcatttgaacccttagaggacattgtaggattattaattggcctaatttcaatattgttatatccccaggaataggagggccaaaggagaggaggggagatggggaacagcctgtcagtggagcagagagaacacacagcacttatggattaagttggccatcttagatgagtacagttcatgtcatcccaaaacaattacaatagtaacatcaaagatcactgattaaagatcaccataacaaatataataataattaaaacatttaaatattgcaagagttaccaaaatgtgacagagagagaagtgagcgcatgcttttggagtaattgggctaatacccttggtcaacacaggattgccacagatattccatttgttaaaaaagacaccttctgtgaagtataataaagtgaagcacaataaagtgtggtatcttgttcatatatgtgtgtgtattccattttttattgatatattcatcaatggacatttgggtaatgctcaccttttggttattgtatataatgctgttatgaacattagtgctcaagcatctgttcaagtccttactttcaattcttttgggaatatgcctagacatggtattgctggattacatggtaattctatgtttaacttttttgaggaatcaccatattgtcttttgcaatagctttaccactttatattcctaccagcaatgtccaagagttccaatttttccacatcttgccaacactcatcttctgtttttctctttttaagtaaagaattttaagtgccaaaaacaatatatgggagatttgtaagtatattttttttctaggaattttgaccacagcaatatctaggaggggacttccaaaagctcctgaaataatagaattgaaagataaaaaaagaaaaaatatataataataataataataataactgtatttctcaacataaacttcatcaagttcaagatagttttgtaaacaatgataccagacatttattccatccctaaagaattgagggtcctgagaatgtaaccatgtcaatgctatcttttttacattattaatggaagaaaaacaagtgcctttaaagatttttttaagattaagaaacaaagcagtagccagaggagccaaatcaggactgtaaagtgtatgcctaatgatttcccatcaaaactcttgcaaaattgcctttattggatgataggactgagacggagcattgtcctaaaaaaaaagaaggattctctggtgaaggtttcttcagggtttcttttttgtttgtttgttttttgttgttttttgttttatttttcttttgttgttgttgttgttgtttgtttttgctaaagatttggctaaatttctcaaagcactcttacaataagaacatattattgttctttgaccatccagaaagtcaacaaacaaaatgccttgaacattccaaataccattgccatgacctttgctcttggcagatgtggttttgcttcaagtgacttcctcctcttggtatccattgctttgattgtgctttgtcttcaggattgtaccagtaaagctatgtttcatctcctattataattcttggagtaaattttcaggatcttgatcccacttgtttaaaatttccattaaaagctctactgttgcctgtggcttgcctgggcacaatggttctggcacccattcagtggaaagttagttcaactttttcagtcagaattgggttgagatgtttatgatgttggctatttttttgtgctattaattcttagttctcttcagttagaatactgatgttaccaggaattctgggttgagatgtattatttaactgaggacatccacagaactggagcattggaccagcaatctcagtttttgtgatagtgaacaaagaattgcaaactaacaccaaaatgcaagttcaaagcagagtttattgaagcactgtaatatactctcagagggagagcagacctatttctgtgaagtgaaatcagcccctctttacaaaactcagaggactttcatggaggttttgtgggaggagttgaggtttgggctatgtgtgagtgacaagatgaagtcatttgattggcagtttacggatacatagctaaaattaaactgtacatgtttttacccataatttgttaagaaaagccaagttggagggtgggggggttggtaaagccacatgtaaattttattataacgatggtataatgagcttgggatgaacttgaggacacagttctgtgttaggggatttccacctgtgccctagtttctccttctccaggacatgttggacacagattttattacaaactccatcctttaggatggatggagttagggaagttctggggctgaatttagatgagctatgggctgtcttagtgataacctttttgttctcttttcttacccgctcccagcttctaatatctatctaactacctaacactaacaaaattatatttttaaagacatagatgtggatgatctgccactttgggattcatcttcaacatcaacttatcctttttaaaatgaattatctatttgtaaagtgcttatttctttagagcattttccccaaaaacttttttaagacataaatgatttcacattcttccactaatcttcaccataaatttgatgtttgttcttgctttagttttagcagaattcaatttgttctgataggaactctcttcaaattgatgtcttattctttttagtgtctcaaactagattctgttcagaaatgctataacaagtaagtatgagtttatttaggtacaaaaatgtttaaaatgtatgcatagttttttcataatatgcatttttcatgaactttttgaaaaccccttgtatcacattctcttcccattattctaacatgggctggtggcaatagccttaaattaatgctggtataaaagtcaaaccaagtagctatattctctccaataatattagctacatcttattacacccgtctccttttctaaaaagtgtctagtcataattactcctactgaatgaaaaaaagtagatatttatttgtgtaaattcttataatacagtatttatgaaacctccacaattctccaaaagcagagaatatacatttgaattcatttaaagaaacaaaacaatttcaatttgattcagatagatcacataaacttaatcccctctttatatttttctttattttcaatggatcctataacatatatatgtcatttctattttgagaaaaaagtcatacaaatagtcgtaagctttaagatctggattaatatgcattattttattttaaagtaatgagtaggtgaaagtcagtgttatctagcatggaatttgatcttattctgctctttcaaaaaagaaattacaactgtaagtaacatattttaagaagactattagccaggcatagaaagaaaaatattgaatgatcttagctatatagagaattagaaaaagtggaactaataggaatgcagactagaaaatggttatcagaggcggggaagggtgatggacaaggaaaagggagatgttgatcaaaaggtataaggtttcagttagacaggagaaataagatttagtgatctattatgcaacatggtgactagaagaaataataaggtagatttcaaaattgctaacataatagattttaaatgttttcactaaaaattaagtatatgagttaatgaatttgttaattagcttgatttaatcatccaacattataaacatatatcaaaatgtcacattgtatcctatgaatatatacaattattatttgccaattaaaaataaaatttaggctgggtgcctataatcccaagcatgttaggaggccaggagttggagctcaggagttatagtccaccttgggccaaatggagaaactccatctctatagaaaatataaaaattagctgggtgtgatggtgcattcctgtagtcccagctacttgagaggttgagatgggaggattgcttaagcttgggaagtggaggttgcagtgagccatgtttttgtcattgcactccagcctgggtgacagagtgagactctgtctcaaataaaatttaatttaattcaaaaaaacgaaaataaatgatataaactacaacaaataagactgacatctaaaatgacaatataattttaataaatcaaattacacttaattatatatttaatagtttaaaaaatattgccaattaactgacaactgaaaagcagagaaggagccattattcatagataacagatgggcacatttaaagattcaggagtagaaccatagctatttcttgataagacaataatataaacagtaaggggcttttccacaaatgaaggcactatcttaaaatagagatattttaaacatgaggttttgattgctttaatgacctaatgcattcatacatttaaaatttacttaatatctactatgtgtccagtactgtgctaggcaagagcagactcaaacaattctttggttttctaattcaggtattattcaattctttacagccatcatatttttatttaagaaatggcttgtactacctaaactaattgtaaccttaaatgaagtaacaacttataatcaatttaatacattcattgactaattccacaaacatatacttatttcccactctggaccagaccttatgctccatgttagtgagcaggtatgatgcttttccctccctaaatagttcagagacatttcattataattgattctggatcagtgcactaatccagaggataaatcctcttttttcatttttggttagttatataaagcttaggataaggaatttaaaaaaaagctatttcttaacctttaaagacacaagagattttctatttattttctcaattctgtgctgcattagctaatctcaaaaactttctggcatgataccaaaatgaactgagatcttcagcatgctttgaatcagtctccaaataaagagatcattgagcttccaaatgatgttgaaactcattatcctccaacagggaagcattaagccattatcccctggaaacattattactatgaaacatctgcaaacatcagtacatggtcagagattgatgagatccacttttttgtaggtttaaatatattcaaaagatgaagaaaatcaatgaacatttataagtaatgagagaaaaaagatcttatagcttaagcccattttgtaggatgtagtaatgtacccataaaactacagaattacttataagcctattaggatgtgacattaatctaaatgtggggataatgaacatagctatagaaattgacaatcaggaatttgtaagagtgaatgcattgaaattatgagccatctaaatgaaataaattggaaatcaacaatggatataattgacaagctggaagtagcttccctgttagaggtcttgtagacttatggaaataaaataaagtcattcaaatattaatagtcaatttttcttcctaaaatctttcagataaatagaaaactctcaaaatgatcaaccttgaaatatttcagaagttctttcagctttcctaaaactaaggaaatcaaaatattcagaataactgtaaatgagatagaactgtattctgtggctcagtcgaattaggataaaaagaactttatgtaaattaaattaagatattaaaaattaataagataattggccaggtgtgttggttcatgcctgtaatctgagtacttcgggaggctgagacggggtagattgcttgagctcagaagttcaagaccagcatgggcaatatggcaaaaccctgtctctacaaaaaataacagaaattagctgggcatggttgtttgcacctgttaatcccaactacttgggaggtcaaaatgggaatgatcacttaagcctgggaagtgcgggttgcatgagccaagattgcgccactgcaccatagtctgttgcagtgagaccctgtctcaaaaaacaaacaaaaaaaccccagagtgagaccttgtatcaaaaaataggataatcaggtatatatatatatatatatttaatgtttaaaatattaacattaatatacatttagtgtaataataaacattaatatacatttaatgtttaaaaagtacaggaccacaaagtgattctgtgagcagtccttaaaaacatctgtcatattacagctacgctgtgagtatgtttcaaaatgttgaacaattatcacctgaatctttaacccaggtattggagagcaatgaccagatccctattggctttgttggcaattaaaaggatggtaaagatttcttttctcatcttaaaattgtgtttgctttcctattagcaagtattaacataatataaaaagtgatctaatattacagatcaaggtgtcaaaattgttttcatgttgaattaaatcattgttttaaattattgaatgtagaaactagcaattattacattatttcacatacacagaacaagaaaaaatgtagagtatagagcagtggtccccatgccctgggctgctaccagtctgttgcctgttaggaaccaggccatacagcaggaggtgagccatgagcgagaaatcttcatctttatttacagctactctgcatggctcacattaccacctgagctctgccacctgtcagatcagcagcagaattagattctcataggagaacgaaccctattgtgaactgtgcatgcgaggaagctaggttgtgcgttccttatgagaatctaatgtctgatgatctgtcactgtctcccatcacccccagatgggaccatctagttgcaggaaaacacgctcagggctcccaccaattctacaatatgctgagttgtataattatttcattatatattacaatgaaatatataatagaaataaagtgcaccataaatataatgcatttgattcatcccgaaagcatcccttgccctgtctgtggaaaaattgtctttcatgaaaccaatccctggtgccaaaaaggttagggaccacctacataggctgtgcttaggagtcattttgatatagatgaatatgccagctctgctattttttatacctgtaatctgagacaaatctattaaactttctaaatttaaatgttctcatctgcacaaggtatataatatctatatcttaggattgttatatatggttacttcttataaaatacttagtagaccacctcacacatagtactcttccaaaattattagctattattagtgattattatttaatcatattagttactagtgaaagtgtttgcagtgtgtatggtataactgtggcttccagatacttgtagcatacagatagcaaataagagtatttgagcaggaaaggaaagagaaataggcaaggcattcattctcttggaaaattccatgtcattctatttgcattttacatttaactatctctgcttgaaacacagaaaaatgtcacttatactatttgaagttattctaaaataatgttatgtatttaaaaatattaatacaagtagttgaacaaaataaagctaatttgaaaattaaatcaatattatctctaaagatataaaaatcccagatttacccaggaaaacttctgctattgaaatgtagtcacttaagaggtttgtgaacagaatttttaaaaatcccagtccacaaaccatcatgtcagagagacaatacctagaaaatctaataaattatgttgtattgactacatctgctgaatagtcccttatgtgaattcattcaatctattccattctttgatgaatatccttgttctaaaaaaagtctcaatttttatttcttttctttctattattggctgaaagaagctagccataaacaatcaggtccacagctgcctatgagaattatgaggctctttcagagttattgggaaactccctgagttgctgccctgcagacttaggctgattttttgcttttggctccttatcttgtcactcaatagaagaaggcatcagaaggttaccaccaagctgaaactgaaatagtctccactgaccccatggcatgaacctttcattttgttctctgggatgggtcacatcttatttgtccattgtaaatttgtagtgtctattcactgaattccctttcagtattttaaatcaatttctcaggggcttcctaggaaaacaagcacaaaagaacagaatttgagatgccactcatgaacttacttgtcttgtctttgcaagtaggatccagtccaaataaaggtacaaagccttggtcaagaatttcagttttttaaaccttatataaagaaactcacaaatctgtcattcccttaagttaattatagttaccctatgtttgccagccttatagtgtatataaaattggttataaattaacattacaaataaagttattattttacttctttgaaagtaattaattgatacatagtgaattaatatgcacaggcagttttatttcatcaactattctattgcaaaaataccaagtcacttttcaaatcttaatgttagaatagtcattatctaaaacttgagataagagtttcattacttaacatatagtgaaaaagaattcttaattctattttcattgtaagtacttaatctctgagatttcacccttccaaaatttcccacattcctgacccaatgaagcaaatggtgatccccattttggcataccagattggcaggagcaagaggcttttgcagggattcctaaaattacatgaagtcattactgatatttgcccagtaggtacttatttcacatattcactgttgacagttggactcaactactggtctcctttaggactagacttgattccactctcattggtccatatctgtgccatgataattgttaattttgaatgcagtagtctacccccactatccatggtttcagttacttgcagtcaaccttgatccaaaaatattaagcagaaaatatcagaaataaacaattcatgttttaaattccacgccattttcaggagtgtgatgaaatcctgcattgtcccactccatccctttcagtcatgaatcattctgttacctggcctattcagctgtatttactatttgcccaggagtcaggagccatctaggttactagattgaaaaagcctaggagatacagagttcggtaccatccgagattttaggtattcactaggagtcttggaatatatgcccctaggataaggggaagctactgtaatatgtattgttgccccactagaaaacctgatgctatgttgaggcccaggaagctacaaatgtatatgcacacgcattatttctctttcagattctagtgagtgcacttagagagaaaagcattgtcttgttagaaaaagcatgggcctgggaatttgtcatcctggcctccagacgcatttttgcattaattaaatttctgcccttaggtagatcatttaaccctgtctgcattccatttcatctggaaagtgtgaaagttttaagtgtatataaaagatttaagatttatagagaggatatatgtccatctaatatgcttttcatttaaaaattatatttccattttgggtcattgctaagtagaagagatgcagttgaaaaatgaaatgcttacctatcagtggacaaaatgagaaatgttgaaaaaagtccaaatgaagagtgagagacgctggaggggaaggaaagacagagagcttggctgaggctttctaagaggccagtccttcccagagagcatggtaggctctttggatggtatacagatattgtgaggcctttagttatcatttgacgagtttctacttcagtaattagtgcacagtttaagcacttaaataactgaactcttgtgcttaaggtgtaattagtctgaagagcaaaggaaatattattaaaaataagattgactttgtacatcagaactattaatagtacagctcctattgcatatgatgtagtaggtgctttagaaaggaaagaaagtttagatgtaagagatctggaaatcaaacggttagattataaaatataaatttaaaggcagcataatcaattaaatatatccaaccatcactaaatctgaaatttggaatactacaattgactcctcttctagcaatttaaggaaacaaaatgtggtatataatggccattgaacatttatcattattagtaaagtctgaacaggaattgtattgcttttattttattagaaactttttgatgccatttatatttattcactcaacaataatctgatctagcattaacgtcatcatcctcccatccccatatgattttgagacatattgtacaatctagaaataacactggtaaacattgaaaacacctgtaatcacttcatgacttaatcatcaacgtagaattgaactcacagaaaataatttgtttcactgagaagagagaccatggatgttgtccatgattattgccattaaatttcatcattcattatgtgtttctggctacagaatgataaatgaatttactgtgaaatgtaaaactgctacatattcaggaatataaaataaaatgtggctgagaataagcatctaagtaaacttcttcagatctcctgaaaaaaaaaaataattttcctgaaagtgagtggcacagccccataagccaaatttaaagaaccttttgttaggctctttaacatggcaatggtatgatgttgggggaagaggggatacatgaaaattcacactcataggctatgatctacctcctaggcaggaactactgtctgagggtcacatgataagatacctaagtgggtttgtttattggtttccctgttttagtcttgtatgggtgtggaatattattgaatgttgggcttttttggcatcaatttttataatcttttgttcttgttttttctctgtctctattttgtatgtgttaacatatgaatagaactagcagaactatcagtgttaaactaccctggtgttcctgtgattaacccaactgggatattatgcagtattatttatatggatttggcttaccatcttttgcttagaatttttccatctattttaagtgagataagagagctaagttttaaaaatatttcatagcaaatagtcaagtaatgtttcagactactgcatggttttttctttttttttttgtatttgtatacatttatggggaagaggtatgatttagtttccctgaaactacctatttgctttgcaaaaattttcttcttactgtggagagatattttaggaactaataggtctttttaaggaaacagttgtcagaagtttagaaaatttttcagcttcagtttttttctattaaattcaattaaaattaaaacatttttattaaaaaatgtgtatgaatgtgtcccatttttcaattcattatgcattctatctgaacatatgcagaaagaggtgtctaaataatgtttgtacattattatgatctttatgtttcagttttaggtgattcaaaattttatttagtcatttctagttcataaatttatgtcataatcatacatggttttatcagcaaagaaagctgtaattctttttaaaataaaatatatagttacctgttttcttgcctttaacatcaatgttgaggcaatgtgcctcaatattttctttttctacaattaagtctaaattattatcactgcaaattgacatctttgtgcataacctgcgcatatgctgggctgatgttccaacgacaagcacccttagggtctgaaggctagggtctgcttgagatccatgaccatctgttctgattggcctttgcccctgccacctttgtctttaaacatttgggctgtcatccacaggtgtatgaaagaaaatattaactaaacttaaatgtcataaatctttgtaaataaagattataaaataatattattataaactaagactcaaaagcaaatactatattttatttttcaccatcagcatgaaaataatgtgtgaactaagagttcatttattatttgcttgtttgaaacctgaggaaaactgaccagatgacctcgctcatagttctagcagaatgaggcaatgaggaggggtaaaaaaagaatcatgaggaaaaatgacttgagttccagatttgaaaccaacagaggtcacccaaaggaaagaagaagaagctatcaattaccatagcaagatgttgattctgagttggctctcagatcttcccgtctccctgctcctttcttgtggcagtcagggaccggtgaatctgcttctttttctgatgctggtactttaacactactactaatgatgatgatgatgataataataataataataataataataataataatttttgctctattttctttttctgaatagacgtttacttttgtaccttacccaagagcaaaaatgaatttccgaagcctggttattagtctctagagatataataaggtttttcactactagcaataatagcaaagaaaaatttaacatttctaggtatcataagacaagtggtcacgatgaaaactggaatcagacctaggaccagttctgtggaaaagtagaatcactttctcacatcagattttactttctagttctttgcttgcttctacttgtatctctcctctgagactgttctattgaaggtcttcagttatatcaatgcaagaattaagtatatacacctttcagcttttgactgaaattatttcatttctctaggcacttgagacagtagcctattctgttatctgtgaaaggttcttcatagatgctgagacaacttctctcatttctttccgttttgaccattcactcagatgcttctttgcttatatgctgtagccttccccatcaccttttaaaaattattctgttcagaatatgtaaggaacacaaacaaatccataggaaaaaatctaataatccaatcaaaaaatgggcagaagttttaaatggatatttctcaaaagaagacatacaaatggcaaacaggcatatgaaaatgtgctcaacatcattgattataataaaaatgcaagttaaaactacagtgagatatcatctcaccagttaaaatggcttatatccaaaacacaggcaataacaaatgctagtaaagatgtatagaaaagggaacacttatacaccactggtgagaatgtcaattagtacatccactatagaggacagtttggagtttcctcaaaaaaccaaaattagagctaccatatgatccagcaatccctctgctgggtatcagtatatcagagagatatctgtatttccatgttggttgcagcactgtttacaatagccaacatttggaagcaacctgtctccataaacagatgaatggataaagaaaatgtggtacttacacacaatggagtactattcagccataaaaaacaatgagatcctgtcatttgcaacaacatggatggaactggagatcattatgttaagtgaaataagctacccacagaaagacaaacatcacatgttctcacttatttgtaggatctaaaaatcaaagcaattgacctcatggacataatgagtaaaaggatggttaccagaggctagggagagtaatggggggctgggagggaaaagtcgggatggttaatgtgtaccaaacaaatagtaagagagaatgaataagacctactatttgatagcacatcagagtaaatatagtcaataatcaatatacatttaaaaataactacaatagtataaatatacatttaaaaaatcctgtaattgtgttacaggattttttgtaacacaaaggataaatgcttgagaggatggatacccatttcccatgatgcgattattacatattacatgcctatatgaaaaatgtgatatgctccatcaatgtatgtaccaactatgtacacaaaaaattaaaaattaaaaaatattctatttaaaaaatccatatatcttattgtatgtttcttctagagtcaccggctccaccctgatgctttcaaaaactacctatttgttgataaattgtttcagatttctctcttggggtttataactgttaatatctactcagtttttggtttgatatcactggctggctgctgcatgttacttcacactggataaatccaacagagccattttatcatccaacaagaaaaaaggagttagctcagatttttccctttgctgaatgttccactttcgaacagcctctaattttataaatgatatgatttctcatccataatatctcatctttcacctaaaaacccatgctgttctcttcgctcaacatcttaccatctctctcacctggataattgcaatggactcctacctggtctctcagcttcaaaccttatatcctcagatctgtcctgtactctgctgtcagtaaggcttctaaaacacaaaactaataattttgttctctttcattgttttggtccattttctcctgaatcaggtatgtatcatggcaaatgggggcccttcattatctggctctgtgccttcctttcactctgtcccgccttgcagtttgaacttcaagcaccctgaattcttaccagttttcggaagataacaaactctgttgagttgttgtgtctttatatcattgcccattctattatctttctctagaatgccttcctctcaataggaacatttgctttttttcttcccagcactttgtttaaatattgtcttttctaaaaaattccttgaccacccctttcttcctccttccttctctctctttcttctttctttctttctctttctttcccttgctttccctttctctcccttcctaccttccctcctctgtctctctctctttccttccttcctttccttctttctttctttctttctctctttcctttctttctttctttctttctttctttctttctttctttctttctttctttctctctttctctctttcctttctttctttctctctttctctctttccttctttccttctttcatggagtttcactcttgttgcccaggctggagtgcagtggcacaatcttggctccccacaacctccacctcccaggttcaagcaattctcctgcctcagcctcccgagtagctgggattacagccatgagccatcacacctggcaaattttttgtatttttagtagagacggggtttctccatgttggtctggctgatctcaaactcccgacctctggtgatccacctgccttgggctcccaaagtgctgggattacaggcctgagccactgcacctggccgaccacctctttctcagaaggaatttactcagctttatttcagtgttacttccattgtaacgtttgtgtacatcaatactgcagtcctaataattcactttacaactacaacatggaaataatatagaactctgaaaattgctgggagtgtaaaatgagataagtatgtgaaaatgccaggaacatagcaggtgctcagaaaagcatgaacttttttttttctatctatatatttacagaaactgactatctctggagcaatttttgttatttttattggtttctctaattaaatggttgcttttgcaccatttctctaatgcaaaaatttaaaaatatattttattttgaagtgtctgtatgtttggaagataatgacagaattgtgaatgctggcgcctagatatacaaagaacaacacctatcaaggtgtttcttacatttctttttcaaagatggcaattactgaatatttaattgctgcattaagaaagattcggaacttgataaccagtgagggaggaaggaggagggagaaggagttgtggggtctacccttttcgcttatctcttcctttccaacacacctgccacttgaaatcaccctcatttactcgagactgccacagatgcaggagaaatagtaagaaaatcttttttggtacaggctctctattggtgatactgtttatatttaagtcagcagtaaaataagatttgcttaaaacaaatgcctagggtagcttcctgtgaatatgggatacatttaggttggacatagttaggttcaatatttctcttattctgtaaagtcactttaaaccaaaatcatgttatctgaaatataaattaattaacacatcctatttaacaaaagaaaatgtcaaggtctcctaagctaattagtgattcatctttctcaactatcatttttcatccacaattagagagaaagcttttgattgttgtagctatcatttttctttttataagttgtaaaacatgtactaggacacatctttggtgaacatattgtcatctaccaatataatggcacattattttttttcatcaaaatgataaagtcttttgatgaacatattctttgattttataaaagtgatcaggtttccagtccagtgactgcaattttaaagggattcattaaacacagtggactaattatcttgagcagtcatctttctctgagttttgaaaagccagtccaaaagtgaattttattatagagttattacagagaaagatctgtaagtacacatccaaatcttttctagtgtctagttcaaatgtttttccatcttttttttggtttgtgcacacttatttagagaaggtaaaagacaggtcaggtgtgtgactgtgacctgtactagaattctctgccaggaaagcagttttgatttgaaaaattgctttcaaaaaagtctgaaaataagtaattgaaactaaagtggaaaatgtactgaaagttaataccgtaagttgagcaaataatttcttgctcaaatatacttggtttaatgactcacagcataaaatacaattattgtaaagtaatagcctattcttctaatgttttggaatatgtatgttaatttcaggaagcctcataagcgctgttttttttcatggcaatgaaaccaacttaaccctaaccttaaattggggcttaacaaaaggatgcatctcaacaatctcataacatgattctggtttgaatcactttcttggctctggcctcaaactctcttcagctccagattctggttcaaacatctactaaatgttctgaagttcttcaatgaaaaagatttgtcactgactttcttatcttcttaatgcaaacatcagactgcattctctttaaattaatggcactgccctccgtataatcttcccagctaaaattctcagagtgctctttagtcctcttcctcccttagccctccacacccattccctgaccatatcccgttagcttcatctctgaaatacttctcagatcattttctcttttccggtctcaggaccattgtgtcaattcctgctcccaccttctctgaccttgattattgctcttgttttctaactggtgtatctgcttcacccttacctaatttatttttattttaactgccaccaacttaatggaatagaatacaaatcttcttcatcttgcttaaatacctagtttttctcgatgaattatagtttatactcattaaagtatgtaagttagtgtatgaccccaaactattttcctaagggcatctcctgcacttcttacttctctttccagcccaacttttcatcctccaggtctttgcacaaactttctttctattaaaaattcccttttgtgacttgacttgtacctttctttacctatcacattgatagtcattttaagacagttaaaatgttccatttattaagatccccccaaaaattgaacctctctctattgtgaacctcatcaatagtttgagaaaatatttttcatatcatataatacagagattgtccccaaacttggtaattcccagaataacttgaggaattttaaacaactgaatttcacatgcctagattccactataaatttctgagttattattctgaagatgaggtcctacaggctccctagtaccttgagaggagtgaatttactaagtcatctctctattctcaatctcctggatgattctttgtacaaaaaagtatcttaatgagtagttgcaaaataaaagatgaactaattagttatttagtttttcattcaaatctacaagctcattctgccctactctccatcctaaatctggggtaggttgggctagtgtctactgaaacttgacgagggtatttggagatcctttggctcacagacctctgtagtgttaaagagaccctgttaaagtgaattgagcaagggctttagaaatagaactggattcatgcttggctttactttttttagtactatgatcttggacacattacctaatcaggctgagccccagttacttcacatgtaaaatggtgattagattaaatgctacagagaagagagcagggagaattaagttaaaggagatggtgaaggtaaagcatggaacagagtgggcatgtatcatatggaggttcctattacaacaaatctttagtcattttcactaacttcatgagttaacatctgataatagttcatcaatgaactctttcttccaatatttaacacattaaatctgtaactataggcacagaattttgctcaccaatttgaaataagatacacagctctcactcaattatcattcaagaggaaaacatcaagggtaaaataactccgcatctatggtctacagtcctgctttcgtctagggaaggttaaagaatgaagaccaatttaggggatataaaatatttgggaaagtctttggacacctatcctttgtacaaggccactggaacactttctgagctcccaaaggaaagaagagtccactcacactaatatgtggtgtagagatacgtctagctgagcgatgatataagaacatttgtgtatgatggaatgatgttgcagcatttatatctactcatcactctctcttaatcttgatagacttgaacaatagtaattccaaggtaagccatatcatttagaatattccattgttaaacatacttcagaggaagttattaattgataattaattattctattttaatttggccaagaaaacctatcattttggcaactgtactttgagaccatgcttcacatgatatttttgtttacactctacatctgtgcctgtgtgcaataaatcaggctcaatagtgtctttcctgtcacattccatcatgtcacactaataaaatttgacatgctcagggatgtggcgatgaataaccgtatgtgatgacaccttggggaatgcttaaaaatgatgctctgtgatggtttcaaaaccttatgtatacttccaagttgtctaagtaaccttaactaaatacattgttccagccatgaaaagatcaatttagttctttagcaccaatgtcactaaacgaaattaacatttaagctgattagtaatcactaaataacacaggatcataaaatagagtacacctaatatttcaaaaaagctctaccatatttcatgtgaatgagcagaccaaagctgtaagacactgataaggaaaaacaaagacatttatcataggtttaaaataataaccatttgggacttttgtggttgttattatcttctttattattatatctcctaaaatagtcattatttctataactactaatctggcttctgaactaaatcccctcttcatgctaagaacatcatatcatctagtctttgtcaacattctgcgtcattattcccatttactagttgactaaacagagactgaagaaatggaattaacaagctgaaattcacatagctgataagtagcagaattaaaactagaattcagatattttgtgctgtgtccaaacactgcaatttccagatccttccagtctcttgtgccccttggagctgaacattttcccaggacaccatatccttgtgggactccaaccacctttcctggagagattgccttgtggttaggattctcttcaccaagagaagaagggctagagatctctatctgagaactgagagctgactcctacaactgtgcagagaaacctccgcagcctgtgaaagcacactgggcaagcctactctgattagtagcacattatgatttctgaagtaaagcagtctctaaaacccagcaggatgcatctagaggaagtcctctttacactcttcttgaacttatatatactagatttggtgctaagctttgaaaatgaagccaacagaacattacctatgttacatgatctcaatagtctacagttttatattaaaaaccacttccccattggaataaactaatccacatgaaataatggcttatgtaatataaactattcctgattttactactatttaacttggaagtggtgaaagtggaatatatactgtagactattgagatcatgtcacccaggtaatgttctgttggcttcattttatatgtatcttttacagagatggggtttcattatgttacccagactggtctcaaagtcctgggctcaagcgatcctcccaccttagcctcccaaagtgctggaattacaaggcatgaaccaccacacctggccttaataggcaagtttttgtaaagaatttcttgctttttatggagaattggtaaaatatcctaatatctggttaaagttgacattatatattccagtttggataaatattatcaaaacattcactcatatgtttgttatttgtaatactttttctgatctagaaaatgcaatatcatagtgatttttaggggtagtttctgtagcaatatgagatagtaaattttatccacatttattatatatgatttgtcataaacagcatgttgataatgatctacacagataatgaatgagtaatgtgatgaataagaggaacatatttaggatttgtcatatgatatgtcatctttgaaaagctaataatattcttcactctctagtttaagattagtatctgtatatttcagtctgtagcatgtggacaacatcccttttcaggggcggggggaagtcttattgaatgggaatataatttgctacagctggtcaccattttttaacaagtatagatacacatctccctagcccactttcttttactttttttaaaaacattcaattccccaatgagttctgaagatttatcatgatttcatctcataaacaaatacaaaactttaaatattgggattgaaaatgactatgaagataccatctaactgtgtagtttttccaaatgcattttatctgtctaaccaaagtcaaattcctaaatagcttttgacccaaaaatagaatctagaaaaatatagttcatttgttgattcaatgcaatgtaaggtagatctgaaataaaattcccaattgtttgggaaaataatcctaatacttctcatttactaatacctttaattttgttcctaaagtgaaaccacagctaccagcaaaagcatttgttgggttgaactttttttttttaataggttgggcatctttttatatttatgggctttaaatattcttttattattattattattatactttaagttttagggtacatgtgcacaatgtgcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgaattctcatattcactatgagtgagaatatgtggtgttcggttttttgttcttccgatagtttactgagaatgatgatttccaatttcatccatgtccctacaaaggacatgaactcatcattttttatggctgcatagaattccatggtgtatatgtgccacattttcttaatccagaacttttatagttaaagccacagatttttttagaaagttcttaatcaaaatggtaaagataaagccaagtttggtattgagtaaacacatgggaacatattttcagtattgtttaaagacatgatggagagtgttaccagtaagtaacattatcatcaagaataataaaaaccacggattttgtacctattgtgtccctatgccaaccaccaaaataagagcttcatgtaaaagctttatagttaaagctcagtattttttaacttacaagttttgtttgttgaatgtcactttttgaattgtgaaaccttgtttctgttattcctttcttcttttgattttttggtgggggtgagaagtaaagggcttaatttatcaattttttgccttcagaacagataaattattaaagaatcagccaaatgcaatggcttattatgtgttttatgaaaaataggagagttaactctaatgtttccatttcatttagtgttatctttttttcctttgcttatctgtttgatttctatcacttctgggttatcagtaataagtctagtcaaaagcagttataacggaaacagcattggtcacttttagcaaaaaaaaatgtatttttaataatttatgaattttcaatgactaaagttgaagtggatagtagagcagtgtgttgaacctatacctgcttcataaacattttctgcatagatcttcagttgaaaagagacaataattctaaatgcaggtgtcgtcctttaaatgaattagatctattttcctcttctctccctttcttcttatttccttccccttttcatttttcttcctttgtttctttcttcttcctctcctccctccattccttcccactagataggttggcaaatataagctgatatttttacgcaagggaatgaccatttttacattttgttagtttgaaaggatttttttttctacacctaaattactatctctcaaataatgcttcttcaagcattcttcaagggttttaaaatgtaccaccgaaaatactcattttgttataaaatgagctttgataacactacatattctactatagaataaccttattagcatgtaagtgactcctagaattactatattaagaaaacctgatcaaaaatacccctttcttgactattaccatcttgtgaagtgtcacaagatgtcctatgtgtccaggacagtaatttgagaaacactaaactcagccaattgtagttatacatcaggacccatatgttctcacaagtgccttgtttctttttattttgaaagaaactatcgtggaaaactggggggaaagtcagtaaataaacttaggtggattggtattttgtaaagcaatcaaaatgctagacaattctgtgtcggttgccatagaatgaatggtcagctcacagggagaagaactcaggagtttacatgaagctcttattttgatggttggcacagggacacaataggtacaaaatccgtggtttttattattcttgatgataatgttacttactgataacactgtccaccatgtctttaaacaatactgaaaatatgttcccatgtgtttactcaataccaaacttagctttatctttaccattttgattaagaactttctaaaatttcttctttcatgttgtaatcatataatttggatgtattagatacacagcataacattatgttgctgtctgaagcattaaaataatatctgtaaacttttagatatcagtaccattgtctctaggctaaataatgagattaaggataataatagcacaaatgtatttggtgttttttatttgtcttgctctataccatatattttacatatgttgtgttatttaatcctcagaacagccatatgaggcacatgtcatttcaaggtatacatttctgtgttactttaaaatatgaagaaaatgtgattcattaagagataataacttacccattatcacaaggctgttgcgtagaactttcgggattcaaatcttggtctatcatattcagagctggtgttccaaactgattattctgcttcatgctacaactgtatggctaaaaaaagaaatcaatttgacttttgtagtgcttttctgccattcttacagtctgaaattttaagcataattggggtattacatttaccactcagctatctctgaatttcaagtgttctgctgatgagacatgaactatacagatggtgatatgtctggggtttatacaaaagatagaggatacacaaagaatgacttcagaaggtgatatatgcaagcaggttaaattgaattgatgaataaaatgataaaattgtatttcacaaaaaagaaaaacataagaaaattgcaaagcagaatgggagaaaccaagaacaaatgagaaagcttttttggcacatttgtcaaaaaatgtatatatgaataattttttggaaggcagaatcccttaagataggagttttagcatgtaacttaagggaagacatatgtgcaaacccatgtcatgctaaaattaataaacacactgtacgtaaaattaaatgtctttatatacacagtctgtaaagaactcctgcacttcaaacggaagatttggtttaaagagtgtgattatgaagtactgtatctagtttagactccgggaaccagaattaaaaggcaacttcaacttggttcaacttttcttaggaactaggaagtaaaacaagccaaacatacaattatgctgttagatgctttcagaaaagaaatgagagagtttctaaacagaatcactgcatctcaatgttgacctattgtatatcataccatgtgtttgttatcagaatgtgttttgggaaagttttacaaaacattttaatttataccttgaaaatgacattttatttgtatataagttttatattactggtggctattttctgttaaagaaataatttcagaatgtcaccatattttccacaattgtgaaaaagactttctagattggtgtcctgtcccctggcgtccacaaatgcaatgccttcaagttagactgcttagtgtgcaattattttattgaatattcatttttatgcattgggattccaacataaagtgaattcctgtgcttcaagaaaatatagaacttaatcaccaagttgtacatttaacctttgagcaatgtgggagttaggggcaccaaacccctgcacagtcgaaaatccaggtataattttaaaacgtaactactaataacctgctgttgacaggaagttttaccaataacaatatattaacacatattttatatgttatgtgtatcacatactgtattcatacaataaagtgagctaggaaaaatgttagtaagaagatcataaggaaatactctagtatatttatcaacaccttaagtttgtgttgtctgtttgcaagacgaattgtctgtctgcaatagtaggcaaccacagctgcagactttaatccatggtacatatcaagcaattcaactttttcttgtaatatcatgacttttctctgatttttgagagtactttgagcatcactactggtgctttatgtaagtcccatagcgttatttaaggtttatggtattgcactaaacatgacgaaaagtatgtgaaaagtggaaagatcactttttacttccatacacaatttattggagagatgaacttcccaagtggagatgattaacagattcttgtaatatttgagctcaccacaatagtagtaggagagggttatgaaattattacagcagtatgtacgtaccacagttatgttttatccagttatgaattaatactgcatctttacatttggttatatttctctggactgaatggtaccaggtagggtcggtatttgtgtgaatgagttttcataaattttaactttttataatagatttgtgtatattttaaatgataaaatagactaattttttgcattttttaatgcatttatgacatacctttttcctttttatatatattcttagactatgtggtttgtctgctagtttttttgaattgccacaaatttccaaagaactttccagtatatttctagaaaataattcatgtatgggaggctgagatgggtggatcacctgaggtcaagagttcgagaccagcctggccaacatggtgaaactctgtctctgctaaaaattaaaaaaaaaaaaattagccgggcgtggtggcaggtgtctgtaatctcagctacttgggaggctgaggcaggagaattgctggaacccgggaggtggaggttgcagtgagccacgatcgtgccattgcattccactccgggccgaaaacagcaagacagtgtcttataaataaataaataaataaataaataatccctgtataagtgaactctcgcagttcaaactagtgttgttcaggagtcaactgtattttgaacaaagcaaccaattcttgaaaaatgaagttggaatataagcagggtgtactttctataacgcttttaaaggattgtgaacaattgggaaaatagtttctagaattaatgatttttataaggagaataaaagaaaaatactgcagtaaaaatgtcttagagtttgaactctgtgtattccagctcaggtgaaactgcaaattatggtagctattattaaactaagctaaaatctcaaacagaaaaatgagaggtccaaatggtgattgttaagttatataacttgtcataaagttccttattatataagtaacctcatcttttattatatcttaaatggaaactaaagaaaccacaaaataagaccttctgtggcaatagcagtaaagcaaaataatcattaaagcatagatatgaagatttaataatatcatacaatatctatttcaacagaaatagtacattgtagttgactttaagtaccaataatatatatttaagcttgtttctattcaatgaaatgattagggacactaactgtcttgttagcaaagaaagccttatccacagagaaaagaaaataactatcccagtactctttctcagaacgggcatttttcttctgtatttctctttgtagcctttatagtatttataaactgattatcataagctttttcagtagtaactcctgttaagaaaacacaaatcaatggtactaaaataacttaaagctacatgaagtctttttagtgtgtttgtgcatatgtgtgtgtactgtgtgtgtgtatatatatatatctatatatgtagatatatatacaaactgttccactgcattattttagcatatctgtgagctaaactgaaggagggaaaaagtaaaaggattcagctgtagttgtactaagatacttaatttttatttattttaggtgtttaagagcaaactttatatttcttgctgtgtgcctcaaaagtcctaatgggcaatgaaaacctttctagctaatgctattaggacttgtggtcagttggttagtaaaaagtaaccccttaaagcttaaagaaattgtaagatgatacacacagagctaaccattttaacttaagactatccctgaatcccttgtagtagagctgaatactttttttttttttttttttttttgcacgggcctgctcatgctcaaagtggagttgcacattgtcttttcttgcataaaacatatccttattcatcaacaataactactaatttgggttcttcaaagtacagtgagaacttaattgatacttgtgaagctatattgttacaggccagtctttgttcttggagctcccaagatgggggcgggccactcccaagatggcaggaagccttttgttctctgacctggggttcttggcctcacagattccaaggaatggaaccttgggccatgtggtgagtgttatagctctattagaagccatgggtcaaagaagagaaccgtggaacccagtgactagtgttcagctcaatcaggacgaacccgggcacttagccttgcaggaacaattgcgaacctttagctggattgggagcacagtggacaccctgccccatccggaggagtgaaagtcaatggcaggtctgtgatggtggggaacagcagtggtggacagtgaacgaaacctcagctcgagctggaacaaacacggacctgaacagtgtacacttgcaagatttaatagagtgaaaacagagctcccataggggacccaagggggttgccactcgcggctcgaatgcctgagatttatatcccaatcattgtccctccacctgtgctctcaggcaatatatgatttgactatttctttacctcctgcttttagcctaatttgtattttagtgagccctctttactacctgattggtcgggtgtgagctgagttacaagccctgtgtttaaagttaggtgtggtcaccttccccagctaggcttaggaattcttagtcggcctaggaaatccagctagtcctgtctctcaataggaatgtaaaatctttctagatttatactatttcttcaatagtctaaggtcattgttctcatacataattcgataatatctattcctgagcctttcgaaagcactgaacctagttttcatagaaatagctctttcatttcaaaaatattttatcagtaaaaaaatattcaattaacttatataattagaagtaacaagtataactgccacaaacaggttggggaagaaatatatattcttataagcatacaggtttggatggtgggaagtcaagtgctcaagtgcccaaggatggtatacctgtcacctcatccgagctctagatactatggtttacagagaaataagaagctattggtaagcctgcaagtcagttatttagtgataagttaagagagattttactgaaaaatttcgaaggccttggataaaataagaaaccaacttttaatacacttcaaatatacttcaacattctgtttggacacttagaccccagactgtgcagatctgtggaatagttatttagaaggcatgcatttactgattttaaaatgaagtcactaaacactttattttctttgataaattttgtatgaaaacacatttcaagttgaaattgggtatgaccagaaatccaaaattttactattcatttcaaaatagggaaaaatggatattttatctcatttaggccacagtgatactttaagttttatgtcatggcccaaattgatttacctaaccaatgaaagtgtcaatccattgcctttgtagatgcagaaactacggccttgttctttgcaatagtaaacacaaatgacaaactgcttctagacctccctgagcatgggtaaatctttgttaataaacctatgaaatgtgaaaaagtaaaggtttctttcttttagtttatatctggagtgagctgggaatattgaagttgagggagttgtagggagaagtattggacagtctacccccttcagtagaaggatttgtgagtctccagtagaatcaagctttgtaacacaatctcttactgaggctgaattttttcttgttttcttgttgccttttatgtgcttgtttatttggttttccctgaggtccttgccttggtggtaggtttgtaaagaaaaagtcacataatccccattatattgtttgaagcaaaagagaacactcagctctgcttcaacactttctcccctacaggtgccaccaccagcagcacactgccaatgggctttcccaagttatctctgttctgccttcacacttcgcagatgggtttcctctgcttcaacaatactttgctcattcagaaacccaaccatttttttactcatctttcacctctcagccccaaaacaaacatctcctggccttgcattatttacccagaaaaatctggcatgatcaaatcctgggcttattcttggtaggattaacactatggaacaaaatgcaccaggaaaaaaagtgtttatatgaatgaccaataaggctggtctgcctctagccttaactgaactgtggtttccggtcaatttataacatgtggttatggtgtgaatttctatttaaaaatgcaacaacagcagtaataaattatttggggttcaaagtattcattagggcatttatgtctattaccttatttgttccttgtagtaactcaatgaagtaggcacaaataatgctgctgctgcttcttcttcttcttcttcttcttcttcttcttcttcttcttcttcttcttcttcttcttcttcttcttcctcctcttcctcttcttcctcttcttcctcttcttcctcttcttcttcttcttcttcttctccttctccttctccttctccttcttcttcttcttcgacagagtcttcctctgtcacccaggctggagtgcagtggcgctgtcttagctcactgcaatctctgcctcccgggttcaagcatttcttctgcctcagcctccggagtagctgggactacaaccttgtgccaccacacctggctaatttttgtagttttagtagaaaatgggtttcaccatgttggccaggctggtctcgaactcctgacctcaagtgatccgcctgccttggcctcccaaagtgctgggattacaggtgtgatccccatgtgtgggcagctccatatttttatagattaagagactagggctttgggggattaatttgttcaaattccaatagctagtgttggcaaatgtgatccgagcctggatcatcttattttgaagtctgagatcttaatcctgaaagacattgctgtctctaattaataattgagttattttagacttgggggaactctgagatgccaaacaataggattttgaaatcacaaaaggatctatttgaaatatagtccctgacacttacagaaattgacttgttgtataattgacctaaagtaaggggtgactggcaaaagatgtcatggtctcatcaaaccctgtagctgaaagggcactttgagttcatggcactatataataaaatcagacaaaggaaggaagcataataagttgtgaactagtaactatgacactcagagaccaattgaagaaacagagaacattctagaatatctggatgaggatttagaatatgtcatttgatttgtaaaatatgactttttgacaacattcaagagaatagttcaagcaaaagatggaagagggcaccagtttgcagtagtaaaagagtaaatgggaagtgagaaaatgacagcagttagtataatctacctttcaaaatgtttagcaagatatcctagttaagcaattcagttaagcaaaaatgttgagagtgattgtggctatgtcggtcaagttaatctatacacaggaggtcatttaccatactccttgttgattcttctcgcctatgaaattattttcttttgccttgtcaagtgttttactaactgtacagccactttttctccttcctgaatacagtaaactaaaaatttctttctgacatgttttatagcaatgtaacaaatttaatgttcttaatatacccttgtagaacttgaaaattgaaatataggtatttataaataaccagagtttattatggttaagcaaaattcagggaattgtatctcacttataatttgaaatttaaatcatttgaatcttcgttttctccatctcattttgaagtaataaaacatgatcttagctttggaattggtctttgactagaataaaaatttaagtaaacattttgatccactagtagtgtatatttcattctcacctccctcaaaaggaataaactttaataagtagagctaattatatcacagtgcttggtgaaaacgcattcaacagaaggtaaggagtatagtatgtctagtggtaccaaagaaaaccagggctttgagagacgataattcaaggcaatgattacaatttgaggctgctgcatgggccctcctggggtatgaattaatcctttgaacctttctgtttcacattatttaacaaaggacctaaaattaatggtaatacctctttgactcaaaaagttaatccctgactatgtgaaacatgtgtctggctctccttataaagttagattcaacattatgagcttttattattttataatccagcctacaccattccacaataagttcctctcttctctgtatttattaattgttatagaggtagctgtttttttatatttacctgaattttaatatttgagtaatttaaataagttaaattattttagattttagaatatcacataagtatgaaaataattatgttaaatctatacatcaaatatttaataaagctgatcctatgtgtaccctatgactcagcaatcccactttagaaaacaagttaaagaatatttattgcagttttgttcaatttagtttcaaactagaattaacctgaatgtgcttcaagaatgaaatggataaataaatagtgctatatttctaaaatagaatactgtatcagagtgaaatgaataaaatattgtcacaggcggtcatatgaatggctctgaaaaccataaatgtgagcaaaagaaaccagacacatatgctgatgaatccacctgttatctgtcttctgtctatccatccatttatcatccatccatttatccatccatccatccatccatcatctagctgtatatctaatcaacacaagcaaaattggcctatagtgggatgaaaagttagagtagtgattcttatgatgaaaagggactgtgacacagcatgatggatattacagaactctaacaatattctatttatcttttttaatgttcaaatgatatttttatttatatttttaatttttacaggtacttagtaggtatatatatttatggggtatgtgagatattttgttacaggcattcaatgtgtagtaattacatcagggtaagtaaggatccatcgcctcaagcatttatcatttctttgtgttacagacattccgattatactgttttagttcttttaaaatgtataagagatcaatgttgaatgtacacaactttttgtgctatcaagtactaggtcttatttattccatctaactatatacttttctgcccattaacaatctccacttactctcatcccaccactcactacccttcccagcctctggtaaccatccttctactctccatctccctgagtttaattgttttaatttttggctcccacaaatgagtgagagcatgcaaaatttgtttttgtgtgccttatttatttcacttaatatattctacagttccatctatgttgttgaaaatgacaggatgtcatccctttccttttttatggctgaatagtactccattgtgcatatgtaccacattttctttatctctctgttgatggacacacaagttaattccaaattttgcttactgtgaatagtgctgcaataaacatgggagtataggtatctcttcaacatactcatttactttcttctgggtatatacttaaaagttagattgctggatcttatggtagttctatttttgcttttttgaggaacctccatagtactctccatagtagctgtactaatttacatacccaccaacagggtatgagggtttccttttccatatctttgccaacatttgttattgcctgtcttttgtataaaaaacacataactagggtgacattataactcattttagttttgatttgcattcctatgatgttcaaggatgtagagtgcctttttacatacctgtatgccatgtttatgtctacttttgagaaatgtctattcagatattttgccaatttttaaattgaaacattatttttctattgagttgtttgagctccttatatattctacttattaaattcttgtcagatggatagtttgcaaatattttccctcattttgtgcattgtttcttcactttgttgattgtttcctttgccatgcagaagctttttaagttgatgtgatcttatttatccatgtttgctttggttgcctgtgctcaataaatctttgcccagactaatgacctggagagtttccccaaagttttcttttcatatttttatggttggaggtcttaatttaagtctttaattcattttgttttgattttttcatatgatgagcaataggggcctagttttattcttctgcatatggatatccaattttctcagcaccatttattgaagactgtcctttccctaatgtatgttcttggcacctttgtcgaaaatgagttcattgtagatgtagggatatttttttccgggtgctccattctatttcattggtctatgtgtttttatgtcagtaccatgctcttttggttgctatatttcagtaagataatttgaagctaggtaatgtgattcttccagttttgttctttttgctcaggatagctttggctattctagctctgtgattccatatacattttaggatgactgttgctatttctgtgaagaagttcattggtattttggcagggatgcattcaatgtgtagattgcttttggtagtatgcacattttaacaatattaactcttccaatccatgagcataaaatatcttttcactttctgtgtccttttcaatatttttcatcaatattttataatttttattgtagcaatctttcacttatttggttaaatgtattcctaggtattttattttgtttatagcttttgtaaattagattactttcttgatttctttttcatattgttcacatttaaatgctaccaatttttctataatgactttgtatccagcatctttaatgaatttgttgattagttctaatagtttctggtagattacttagatttttcccaaatataagatcatatcatctgaaaacaaggataatttgacttcctatcaagtttggaggctctcaatttctttctcatgtctaattgctctaattaggacttccagtatgatgttgaataacagtgctgaaagtgagcctccatgttgtgctctagatcttagaggaaaggctttcagtttctccccattcatgataccatgaatgggtatcatggtatatgggtgtatggtctgtatatgggtctgtcatatacagcttttattgtgtagaggtatgttcattccatacccagttttttgagggatttgtttttaatcatgaagagaggttgaattttatgaaatgtcttgtcagtatcagttgaagtgatcatatgattgtgtttttcattctgttgatatgatgtagcacattgactgacttgcatatgttaaaccatctttgcgtgattggaataaatctcacttggtcatgatgaatgatctttttaatgtgttgttgaatttatttttaaaaaatatttttttgaggatttttgcatcagtgtttatcagaaatattggcctgtggttttctttcttttcttttttttctttctttctttctttctttttttttttttttttcatgtttccttgcctggttttggtattagggtaatactagcctcactgaacaagtttggaagtatttcatttttctctattttttggaatagtttgagtaggattggtattagttctttaaaagtttggtgtaattcagctgtgaagttatatgatcccaagtttttccttggtgggagactttttattacagccttgatctcattatttgttattcatcttctcaggttttgaatatcttcatggttcaatcttggtaggttgtatgtatgtagaatttggccatttcttctaggttttcaaattaactggcatatagttgctcatagtagtctgtaatgattatttgaatttctgtggcattagttgtaatatctcctttttcctgtctgattttatttacttcagtcttctcctttttttgttagtctggctaagcttttgtttattttgcttatcttttcaagaagaaacttcatttcattgatattttgtattttttgttcgaatttatttctgctctgatttatattttctctactaattttgggaatagtttgcttttgcttttttagttatttaagatgcatcattaggttgtttatttgaagtttatcttcttttttgacataagcacttatagctaaaacataaactttcctcttagtactaccttagctgtatctcacaggtattggtgtgttgtgttttcattttcatttaagacactttaaaaatttttcttcttaatttcttcattggctcactggtcttttagaagcatattgttcaattaccatgcgtttgtatagtttctgaagttcctcttgttactgatttgtagttttattcccttgtgattagatacttgatgtgatttccattttttcgaatgttttaatgctcgttttgtggccaaatatgttatatccttaagaattttacatgtgctgaggacaatgtgtattctgcagccattgaatgacatgttatatagacatctattaggtccatttggtcaatactgcagaataagtcttaggtttctttgttgattatctgtctaggtgatctgttcaatgatgaaaatggggtgttgaattctccagctattattgtgttgaggtctctctctttggctctaataatatttgctttatattggccaggtgcgttgctcacgcctgtaatcccagcacttttggaggccaaggcgggcggatcacgaggtcaagagaatggcatgaacctgggaggcagagcttacagtgagccgacacagcgccactgcactccagcctgggtgacagagcgagactctgtctcaaaaaaaaaaaagaacaaaaaacaaatatttgctttatgtttataattactatatcctcttgatgaattgacccctttatcaatatttaatgacatttttgtctccttttttgtttgttgtcttgaaatttattttatttgctataaatatagctgctcctgctttgtggcttctatttgcatgaagtatctttttctattctttcatttttagtctttgtgtgtctctataggtgaagtatatttcttgtaggcagcagattgttgggattgcatttcatccatttacatactctatgtcttttgattgggtagtttcatccatttacatttgaggttattatcgataagcaaggatttactcctgccattttttttttctggtggttttgtggtttcttttccttcctttcttccttccttcttataaaatttattttttatagtgctatattttaatttcttgatttttattttttgtgtatctgttgtagtttttaaaatttgagaggactatgaagcttgcaaattacttcttataacccatcattttaaactgatggtgacactgattgcaaaaacaaacaataaaacatgcaaagtgaaaactaataaaaactctacactttaacttcatctttccactttttgacttttgtttctttttgtgtcttattatactgtttatatcttgaaaagttgtcacagttattatttttgatcatttcatctttaagtctttctactcaagatatgagaagtttagataccacaattacggtgttataatattcatatttttctttgtgcttactattcccagtgagctttttgcatttaaaagatttcttattgcttattaacatctgtttctttcatattgaatagctctctttagcatttcctgcagaacaggtctcctgtttataaaatccttcaccttttgttcgtctgggaaagtctttatctctccttcatgtttgaaggatatttttctggaacaattgattctaagagaaaatattttttccttcagcatttaaaatatgtcatgccactctcctaacctgtaaggtttctattgataagtctgttgtcagatattttggaacttctttgtatgtatttgtttcttttgtcacttttaggattctttctttatccttggcctttgggagcttgattactaaatgttttgaggtagttttatttgggttaaatctgcatggtatttaataaccttcttgtacttggatattgatatctttctctaggtttgagaagttctctgttattatctctttgaataaactttctactccaatctctctacttccactgtaaggccaataacttagatttgcccttttgaggctacttcctacattcgtaggcatgttgaattcttttatattctttttttgtctcctccgactgtctttaagctcactatttctttcttctgttaaaaaaaaaatctgctattgagagactctgatgcattcttcagtatagcaattaaatttttcagctccagaatttggttgattttttaaaagtatttaaatctttctgttaaatttatctcatataattaattcctaatctgtggtatcttgaattttgtttaactttcttaaaacagctattttaacttatctgcctgaaaggtcacatatttctgacactccaggattagtcactggtgccttacttggtttgttttgtgaggtcatgattttctggatgatcttgatgcttgtgggtgttcatcaatgtgtgggcattgacgacttatgtatttgttgtcctcatcacagtctgggcttgtttgtacacgtgtttctttagaagactttccaaatattcaaagggaattgtgtgttgtgatctaagtttggtctctgcagccacatctgcattagagggtgccccaagcccagtaacactgtgactcttattgacttgtagagatacttccctggtcatcttggctactatcctggagaattacccagattatcattcagagtctcttgtcctcttcccttaccttttcctaaactaactgagtctctttctccatgctatcctgcctggagtttggggaggagtgaaacaggagtccctgtgtccaccacactgggaccatgctgggccagacttgacgtcagcacagtactgagtctcacccaaagcctgtgttgactattgcttagctaccattgagatttattcaaggtccaagggctctttagatagcagatggtaaagccagccagggttgtgtctttctctgcagggcaacaggttcctttctggcccagggttggtctagaaatgctgtctgatagctagggcctgaagtcaggaacattaggaatttacttggtgctttagtttgctgcagctgaacttatacccaaattgaaagactaagtcctttttactcttctgtttcctttcatcaagcagagtgagtcttgccccatgttcacgcccaccccaggccaatggtgggtactgcctgaatcctgataatgcatattcaagacccaagaaagaactgggtcctttctttcaaggcaatgggctccctcctggctcaaggtgtgtctagaaatgttgtccaagagctaagcctacaatgggggtttcaggactctgcttggtgctttattttactgtagctaagctgttatccaagttgtatgacaaagacttctttactcctctccttcctctgctcaagtggaagaaaatagtctctcctggaaatgttagctgcactgcctggggttagggaaagggtgatgcaagcactctcctggctgccctggctggtgtctcactaggtcatgtgccctgtgaacagaggacagcaccaagacttgcccaggaattgcattccttgtgatctagaatgccttttgtgtttatttaggacaccagagtgctttagcctgtggtaatgaggctaactggaactcaggttctgacaagtgagatggggagtcaccctctggctagtgctggcctgaatgctccctctgtgggtattggtctgaaatgggggccttaaaactctgcctggtaccctactctactgtggctgagctagtatccaagttgaaaggtaatgtcctccttattctcccctatcttttcctcaagtggaaggaaagagtctcttcctaaactgtgagctgcactatctagggttggggatggggtaacataagcactcccttggctgccccagttggtgtctcactgggttgtgtgaaccccaagtccactgactgcaagcccagcatggcaccaggacttgcctaggaattgcattccttgtggcttagacattctttcaaatttacgtaggaccccagcgcactttagcccatgttgacggggctagccataacttatgttctgacttctgggatggacaattcctctctggctagggctagtctaaatgctgccaccatgagtgcaggccaaattatgccttgtgttgcttgcgctataatagagcagcactgagttccaatgcaatgtcccacggtccctgcagtctcccttccccaagcacacagattatttcttcgtgccatgcagacacttctgcggaatgggggaggggtggtctccacaattcaagactgtctttcttcagtggctctttccttgatatcatgttaaaaccaggtactgtgattgctcaccttgttttcaattcttatgaagttattttttgtgaggatagttgctcaatttgctattcctataggggttaaaaatcactaaaggattctatttagccatcttgttttgcctactcccttaaagttctattgatcgggttgctggctataaggatgtgtttacttcatgaaaactcactgatcttatgatttgttcccttattgtgtataatttatgttgtaataaaatatgcactttaaaaaatttgtgtgctaagagcaacatcctaagagaccctttatataccagtttattctctattttgaaccagaccaatagaatgctttaatatttcaacctgtaatctttctgaattgacaactaattgaaatggaaactgcagcaaattaacattgagcagatgacatttaattcaaacagtatcaaataggaaattaccctttctttaaagtgctattacaaagaggtatgctacctaatcatagatattaaatcactaatttttattcattctgttttcaagaagcatagtattgtggatataatttatgcgtctaaaattgagatgccatgtaaaagacacttagagatatgttaaagcacttattccgaagactaagctaatttgaatttgaccttttcagcaatcaaaattctgctaatacagcatattttcctgttcataaaaagatatgtgacaatagaaaaatttagttcaatatatatcaaaacatggagagggaagactaacacagttgtagctactgtccttgataatcccatgataataaaaaccccattaatatttccctcttgctgttgaccaacactcttgagggaatgtgttttctaattaattatcagaagcacaattttgaaattacataaaagaagaacaattaagttcactttttcttgatgaccttgtacaaaataaacttgcccattactccagagaactcaaaaaggagctgagtttcttctctccattactgtaacagtaggtagtatagagctgtgcaatggttatggaaaattattattctctggaaattattagaattgaatggaatgtttttattgctgattcatatactctgatttgagcgccaatcatctgcttctgcacaggattgtactttggttacatctagagttactttgcccatttcttaggggaagatattttttcaaaaacatatatgagtgcattgcatgtctactctgcaccagaaaatttgttaaattctagcaagatactggaatgaatgcattatctgtgttttcaataaatttatactaaagacaaggcataaatgcaaggaagaaattaagaaattgatacaggttatatgtaaagaataaaatacaatgggggctcatgtctggtaaaaattagttttggcaaaagtgaccggagaaggctaataagttgagcctttcatgttggctaaaatataaacatgtggcaataggaggatagcattcctggaagaagagttagaacaaggtgcagtggagaaaaaaaatgggtattaatagtaataatgagtcataaaccttgacaggaacataagctatgtatgggagcaccctgaggaacagaccaaaaagtgtaccgaagccagatcctggagaaattaaacatttgtatgttgttcattagataagtgacctaaatggtattcattttatggtaattatatttaaattaaactagagagtaaaaaaaaagatcctaaaaacgccaaagaagtaatcgaatttggtctgttcatctatgcaggagaaaagtaaggataaatactgatattaaaaagtctgcaaaaatcattttcttttaaaaattatttgttctttctctcagggagaaatgctgtagatttctttccaatgtgcctaaacatttttccccttagcttcaaatactgcattcctaagtacatccacaagttcaggtagagcaaatcttagatgtgtataaaaagttgaatgattttaattttcaaataataccttcttttatggcacaatggctgtgacaagattagccagaatcacagcactcattttatgaagaaaaatatgaagtcagtgacagtcattttatttatgcgtctgtctgcacattcacgtctaaatccttctggcatttgaatatacagcttccaaattcaggatcttgtcgggaggcatgagtcattcagaatccagcagaaatgacaagcgctggaaaatctttttgtgggtccttaatttcagtcttttatagagttagcctttttataagctgatgtcactgtggaaccaagcaaacaccagtaaacaggcaaacagcttcttggctctctaacatgcaaaggctggtctggtctaagattagacatatggaggccggctccaaattaaatcagaatagaatgatggaatcatttagtttgtgatgtaaggagcccttagagatggcctacttgagcattgacactgtgcagacatgttgtggagtactatggacaaacttatggagtggtaggactgcaatctcacacacacatattttaatcaaagcaatgtcctctgatctgatctaatttaaatacatttctagattttcatctgatgaataattcagaaatctgcaaaccaagtccagcagcttatggaatccaggttctagattcatcttatagattatgcaacagttagaaaaagaataaatggcatgtgtaggatcacaggttatttcccctcagccttctcttagagaagaaaaaatggttaacaatgtagtctgtagtatttatgatagcgtaagttaactttaaatgtcagttctttctcttgttaagttctttatcagtttcgtgttcatgtgatttcatgctttctatttattaataataatttagtgcatatgtttctcttttatttaaggaatactcataattctctccctttactacagaaatggatttgatcactgatttctgttgtttctatcactctgtgttatctttatgcaagttattctatccaccttttatcatttttaggaagtgactcaagttactctagagagctatatttggaacaacccacaagttatgtatgaacttagataccaatttaatatccatattataattaacatatttgccaaaactaattgaaatgtacattttgacaaaaacgtgtatattcctatgggcaactagacagaatatttgactgttccagaaaatctgggagaaaattttaatatatttatgtggatttaacagtgacttggcttagacaggtcttaagtcaacagtgacttagctaatgacttagactgacaagtattgatcaatgataagtatccattattgaattatggactctaagggatacaaaataagtagcagaaagaatcttctcaattttacaaaataatgagcaaaataaagcatatttaaagatagcaattagagaatgatacacaaatgtaattacagcttaccatatatgtgaacagatcgatttcagaaagtgaaagagagtttgggacaaggagtccattaaacacatggctgaagctataaacttgatttggactttgaaggaaaaatgtagtttggatatagtacctaacacagaagtcttacgcatagaagatacaaaatatttcttgaagtaaacattcttccagagaagcaggaaaagcatggagtgaccatgaagtttcactgttcctataaaacagtgggaacagagagaacacccctgtgccatagtaactctgaaccttttctgtgtaccttagacttacccatttataaaacagttagtccagtaaatagtgaaagtgagagaaagttcgtcttcaagtctcaaagtaagctactaaaacgacgtattgaaaagacaggatctggtcgggcgcggtggctcatgcttgtaatccccgcactttgaaaggacgaggcaggtggatcaactgaggttgggagttagagacaagcctggccaacatggtgaaaacctgtcttactaaaaatacacaaattagccagatgtggtggcttctgcctgtaatcccagctacttgggaagctgaagcatgaaaatcgcgtgaatcctggagacggaggttgcagtgagccaaaatcacaccactgcactccagcctcagactactgactgcattccagcaacagactgagaccctgtctcaataagaaaaaaagaaaaaaaaaagacacaattttaaaaagttagtccttatataagacttagtgcatccaaaactgtggaagtcatgtagaataatacgttcttatattaaaatctattatggctgcacacagatattgacaggaaaaactgaccatttgaagttgatacttatatagtgaaaagttaactcttaggaagaaaaatatgaaaaattaacaatcagaaagaatatgtacatattatcaattttattagtgataaaataattttgtaaatagaaattataagaacaccatttatgcacaaataaaaagaaagtatttataaaacaaattatccctaacacaaatgagactatcttagaaatattatacacagtatagctaaaagactaattcctattctatctaaaaaaataaaataaaatggatgcatttttaaaagcaagtttgctctgacctacctaaaagttaggctttgggtgaataagaagatataacaccttttttattttgtatagaaaaagtctttgcttgtttgatatagtaagatttatatgatagtattttataagaactagccccatattagcagaaaaaaaggtgaaaacagaaagaaataaagcaatttctgtcatgtggccaaatgcatgtagccaaaactaaacacttaagtatgaatactttcagattttattttcccctgtatttgcattgcttttaagtgttactttttttttttacaatcttcttttgtatataaaagggcaaacaactttgttcgtgtctgaggaatagttcctggtaaaccctctttcagccacctggttttgaaataaatgactttcactccttctgcaatagtaatctgttcttgattttaaaaagatgtttagaaaaagaaaacaaaatacttgttcacctacatgagcctggagtaatatgatatagcagttgtgttgcatttttggggaactgagaaaatcatttttcttctgctcactttgaaaataataagagccctttgcaatgtaatctccctgaggaaacaacacggggacctccacaggcaaaccacttttctagcccctgcctttctaatctaaatctttccatcaatatctgatatattctgtcaaccttgatgactgtcttggaatgtaattccaaatttactctcagcattttatttgcaagagcacaaatatcagagtcctttgatttttttagagattggcttaatctttaacactagacttggaatgttgctatgtggggctctacatttgaaagcaaaacacttggcagggaattaactttagcccttagtggttggaattgaccccctcagtttccaaatctttttcttttgtttctaacatagaaactcatttaaatgaaagagaatatattttcttttgtacaaattttgatggatcatattctttctcaccagtcgattgcaaatgggaaagtacatcagtaaaatcattacattttagtcacttatcttgaatgagtagaaactaagggagctccaaacaaacaaaccatgcagaaaaccaaaataaagtaaaaacagtctgaacaagtggttttcacacattcaaactataattgtaaatcagatgtcttttggcacaaattattagattaaagaaatgtgggagatattaatgtgagacataaaatttactgtaatctcttcttgtgtcttggactttgtctgcagtggcaaagtttggagaagcaagtgagtattcattttttctactgagtaaatcattgtggaaactagtgagcctgaatattcagattcctttccctcgaattcttgtctcactttcatattttattgtcaaaaatattatattaactgacttctttttctcctcaaacataactttgacatgtaaggatcttgttccaaagtaacaaaagttaatgacactgtgttagagttcaaaagaaacttgtcaattaaccaaacccctcttttagaggtaggaaaattgtgaatgaaggaagtcatcacttctagctggtagtaaggccagatatagaccagaagtctccttgatctcctacctgaaaacaggacttataccacatttgcttgtgtgggttgggaaagtcatttgattgtgtttcattttactgtgtttctcagatactgcattttttttctttttttttacaaattgacaaattgaaggtttgtggcaatgccgcatcaaacaagtctacatgtgccattctcccgacagcctgtgctcacttcttgtctctgtgttacacttcggtaattcttacaatatttcaaaccctttcattattattctatttgttatgctgatccatgatcagtgatctttgatgtttatattgtaattgtttggaggcaccaagaaccatgttcatatagaactgtgaacttaaccaataaatgttgtaagtgttctgactgcttcactgagcagcagttcccctatctctctccttctccttggccctccctattccctgagacacaataatattgaaattacgtcgatttttaatcctgcaatgacctctaagtgtttaagaaataggaaagtcatagttctctcacttcaaagcaaaagctagaaattattaagcttagtcaggaaggcatggcaaaagctgagatatgctgaaagcgtggccacttgaatcaaacagttagcaaagttctgaatgcaaaggaaaagttttcaaagaaaattaacagtgctactccagtgaacacacgaatgatgaaaaagcaaaacagctttattgctaatatggagaaagtttgagtggactaaagagaagatcaaatcagtcacaacattcccttaagcaaaagcctaatccagagcaaggccttaactctctttaattctgtgaaagctaggagaggtgaggaagctgtagaagaaaagattgaagctaggagagggtagttcatgaggtttaaagaaagaagccatctctataacattaaagttacaaggtgatgatgtagaaactgcagcaagtgatccagaatatctagctaagatcactgatgaaggtggctataccaggcaaccggttttcaatggcagatgaaagaggcttctattggaagaagataccatatacaactttcatagctaaagagaagaattcctaacaggggataatgtggctggtgactttaagttgaagccagcattcatttaccattcagaaaatcccagactcttgataattatgctaaatctattctgactgtgctctataaatgcaacaacaaagcatggaagacaacacaacattttacatcatggcttactgaatactttaagcccactgttgagccctattactcagaaaaaaaaagattaatttcaaagtgtttctgcccattgacaatgtacctattcacccaagagctctgatgaagatgtataaggagactgttgacctaaaagaagaagccaaggcacaaaatataattttaggtagtttacttgaaccaagatgaggcagctgctcggaagcctcgatccaagtaaccttgtggtatgagccccatttggcctttgttacaagcaggtttttagaggcaaaaaagacaatgagcgggctgatacaaagttattttttaggaatcctcatcggtttacagaaatgacaatgattagtgattatctatacattgtgaactagagtgtatgggccacagtgtccagcatgtggcattcttaggttaatttacagctatttgtggtgacagtctagagtgcatacagcaagcagcttcaagcggggaagcagattgtgactgctgcctcattcccatttctctctgggactgataattccaaatggttggaattcctcagataaatttttttctttcttaaaattaatgtttttatgcttgctaacacaacatccactctgtagcctatgtaatttcaactatcaagccctactatttaatgaaatacatttcataaatttataatgccatagatagtgatttctttgatggatccgggaaaggtaaattgaacaccttctccaaagaattaattattctagatgccattaagaatattcatgtttcatagaaagaggttgaaatatcaatattaacagaagtttaaataagttgtttccagccctcataaacgactttgaggggttcaaaacttcagtggaggaaatcactgcagatatggttttaatagcaagaaaacagccaggcgcggtgacgaaaccctatctttactaaaaatacaaaaattagccgggcatagtggcgcacacctgtaatcccagctactcagtaggctgaggcaggataatcacttgaacctgggaagcagaggctgcagtgagccgagatcgtgccatttcactccagcctgggcaacaagagcaaaactccgtcttaaaaaaaaaaaaaaagcaagaaaactagaattaaaataggggcctgaagatatgactgaattattgtgatttcttaataaaattttaacagacaaggagttgcttcttatgaatgagcaaagaaagtggtttcttgacatgcctgaaatgaatctacttctggtgaaggtgctatgaacattgttcaaatgacaacaaataatttagaatattacataaacttagttgataacgcagctgcaggttttgagaggtttcactccaaattcgaaagaagttctactgtgggcaaactgctatcaaacagcactgcatgctccagaggaacttttcatgaaaggaagagtaaatcaaaattgtcaactgtattattatctaattttaagaaattgccacagataccccaacctttggcaatcaccaccctgatcagtcagcagaaatcaacatcaaggcaagaagaccctccctcagcaaaaagatttttactcgctgaaggctcagatgattgttagcattttttagcaataaaatattttaaaattatgccaggtaccttgctttatggaagtaatgctattgcacacataatagactataggatactgtaaatagaacttttatgtgcacaggaaaccaacaaatacatgtgacttgcttcattgcaatgtttgctttattttcagtgatctgcaactgaaccaatgatatctccgagttctgcctgtgttgcattttcttcatacgaatgaatttttaaagttatacattcgatttaggaaataaaaatgtttcctaaacagagaatctaaaacaaatacccaaactaaatagaaacaagtcttcaagaacaacataaattaaaaactagctatgtaaagtattcatataaaagacaaaattatcacatatatttaagaaaagtaaattttgaaattataaaataaatatttgtcaatatatttaatttccagcattcattatgaatctatgaaatatgcaaacaaggacaatatgattaatttcaatatgattgttgattagctcagcagcaactgataagtggccataaggtgcaagaaattatctttaataacacaaaattgccatctgaatgcttttaaggcctcataaaccctgatagagtgtaagaaatagcccacaaattattgagtttgctatcaactaaattctgaataactcatcaacttttaaggttatgactagagggtatcgattaactgtcttacccactgaagcagttgttataactttagcaatattttaatctctctgtaatgaatcatgaaatctatattttaaaaaagtatttgaatgacattcagtggtatttgcatcatgaaattaaacattcattaccaccaccataaagcaaaaataaaatttaccaccaggacaaacagcctgtatgaaaacggagaaaattaattgcctgaggacattatgtagaaagcagaaatgtcaaagtgtgataggtggcagagagagaaatgtaaactggatgttttagcagttcatcccgtaagaatagcttacatgttaaattatactttgcttacagaaaggtataatttacaaaaactatgaatataattttcattttttgaatgaaataagaaataattataaactctaaaaaaaattgatcctgttatgtatgagataatatctgtctagaacttttctaaaaatgggagcttaaggattcttattaggaggatgaaaaataaattagacttatcattaactgttaacagtttgttgagatataatacactacacatatttaaagtgcacagtttaaccagttgtgacaaatgtatgcatccatgcatcactaaaatcaagatagtttaatgtatctatcacccttgagagttatctaatgcctttttaaaattccttccttctctcttttcaccccctttacccctgtaccgcttctttcccttccacccctccctgagttcaaagtaccactgaaaacaagctaattacccatccacaggggaatggataaaaaacggtggtatgtccatacaatagaatgccattcaacaatggaaatgaagaactgatatgcacaaaatggattaaactaaaaaaaaaagctaagtgaagtcagacaaatatagtgcatgttctatgattccatttatataaaatcttatgaaatgcaaagtaacctatagcgacttattgtttttgaaactaccagatgtatattaccattaccatttatactgaaactattccagaaaattgggaaggaaggactcctacccaattcattctatgaggccatcatcattctgacaccatacctagcagggacacaacaaaaaaagaaaacttcaagccagtgtccatgatgaatatcaatgcaaacatcctcaacaaaatactagaaaaccaaatccagcagcacatcaaaaagcctatccaccatgatcaaatagtatttatcccaggatgcaaggttagttcaacattcataaataaataaacatgattaatcacataaacagaactacaaactaaccacatgattatctcaatagatgcagaaatggccttcaaaaaaattcaacatcctttcatgttaaaaactcaataaactaggtattgaaggaacatgccttaaaataataagagccatacatggcaaacccacagccaatatcatactgaatgggcaaaagctgggaacattcaccttgaaaactggcaaaagacagggatgccctctttcaccactcctattcagcatagtattggaagtcctggacagggaaatcaggcaagagaaagaaataaagggcttctaaacaggaagagaggaagtcaaaccatctttgtttgcaaataacatgatcctatatctagaaaaccctatcatctcagcccaaaagcttcgttttttttttttatagtctactttctatctttatttttttttattcgtattattatactttaagttttagggtacgtgtgcacaatgtgcaggttagttacacatgtatacatgtgccatgctggtgtgctgcacccattaactcgtcatttagcattaggtatacatcctaatgctatccctcacccctccccccaccccacaacagtccccagagtgtgatgttccccttcatgtgtccatttgttctcattgttcaattcccacctatgagtgataacatgttgtgtttggttttttgtccttgtgatagtttgctgagaatgatggtttccagcttcatccatgttcctacaaaggacatgaactcatcattttttatggctgcatagtattccatggtgtatatgtgccacgttttcttaatccagtctatcactgttggacatttgggttgattccaagtctttgctattgtgaatagtgccacaataaacatacgtgtgcatgtgtctttatagcagcatgatttatagtcctttgggtatatgcccagtaacgggatggctgggtcaaatggtatttctagttctagatccctgaggaatcgccacactgacttccacaatggttgaactagtttacagtcccaccaacagtgtaaaagagttcctttttctccacatcctctccagcacctgttgtttcctgactttttaatgattgccattctaactagtgtgagatggtatctcattgtggttttgatttgcatttctctgatggccagtgatggtgagcattttttcatatgttttttggctgcataaatgtcttcttttcagaagtgtctgttcttgtcctttgcccactttttgatggggttgtttgtttttttcttgtaaatttgtttgagttcattgtagattctggatattagccctttgtcggataagtaggttgcgaaaattttctcccattttgtaggttgcctgttcactctgatggtatttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatgattttagatctaacatttaagtctttaatccatcttgaattaatttttgtataaggtgtaaggaagggatccagtttcagctttctatatatggctagccagttttcccagcatcatttattaaataaggaatcctttccccattgcttgtttttctcaggtttgtcaaagatcagatagttgtagatatgcggtgttatttctgagggctctgtcctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttgcttccatatgaactttaaagtagttttttccaattctgtgaagaaagtcattggttgcttgatggggatggcattgaatctataaattaccttgggcagtatggccattttcatgatattgattcttcctacccatgagcatggaatgttcttccatttgtttgtatcctcttttatttccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaaccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaggggatgtgaaggacctcttcaaggagaactacaaaccaaaagcttcttaagctgataagaaacttcagcaaatcttaggatgcaaaatcaatgtgcaaaaatttctagcatttctatacacctacagtaggcaagcagagagccaaatcatgaaagaactcccattcacaattgcttaaaaaaaagaagaaaatacctagaaatataatttacaagagaagtgaaggacctcttgaaagagaactataaaccactgctcaaaaaatcagagaggacacaggcaaatggaaaattattccatgctcatgaataagaagaatcaacatcatgaaaatggccatactgcccaaagtaatttatagatttgaagctattcccattaaactaccatcgacattcttcacagaattagaaaaaactatcttagaattcatatggaaccaaaaaaagagcctgaatagccaatacaatcctaagtgtaaagaacaaagctggaggcaccacaccacctgacttcaaactatacttcaagactacaataaccaaaagagcatgataccagtattaaaacagacccataggccaatgaaatagaatagaaactttggaaataaggccacacacttaaaaccatctgatctttgacaacacgtagaccaatggaacagaatagagaattcggaaataagaccacacacctacaaccatgagatctttgacaaacctgacagtgataagcaatagggaaaggactcctatttaataaatggtgctgggaaagctggctagccatatgcagaaaattgtatctggaccccctccttacaccttatacaaaaattaactcgagatggattaaagacttaaatgtaaaacccaaaaccataaaaacccaggagaaaatctaggcaataacatctgacataggcagaggcaaagatttcatgagagagatgccaaaagcaattgcaacaaaagcaaaaattgacaaatgggatctaattaaactaaagagcttctgtatagcaaaagaaactatcatcagagtgaacagacaacctacaaaatgggagaacatttttgcaatctatccatccaaaaaagggtaatatccagcatctacaaggaacttaaacaaaataacaggaaaaaaaccctattaaaaaatgggcaaaggacatgaatagacacttctcaaaataagacatatgtacgatcaacaaacatatgaaaaaaagctcaacatcactgatcattataaaaatgcagatcaaatctacaatgagagagcatctcacgccaatcagaatggctattagtaaaaagtcaaaaaacaacagatgctggcaagtttgcagagaaataggaatgcttttacactgttggtgggagtgtaaattagttcaaccattatgggagactgtggtgattcctcaaagagctagtggcagaaatactatttgacccagcaatcttaatacctaggtgatgggatgatttgtgcagcaaaccactgtgtcacacatttacctatgtaacaatcctgcacatcctgcagagatagccctgaacttaaaataaaagctgaagaaaaaaaattatctttatatctttcaactactaacacctaaaacaaaacaaaacggaacagaacaaaaaggcctcagtgcctgactgcagcagttttaaaagtttttccagggacaatatgcgttgccacaaaaatctgacaggaagaaaataaaaagcagatgcaaaatatgtgaaaataaaagtgacactaccagctctgcctttgttgatggcttccttttgcaaattgtcttccactaagtaatgtagtctgcataaaaatcctttcatttttcttcctcttttcttccattggctgtttgattataatattttgtatatactataagagttttcatattatctacttttttgtaactgctacatgaaaataaaaagagaagcacttttgaaattttaattatgagaaaaccaggaatcttagatcttgattcaatctatgtcactcggttactcattagaatttatatttttctcttaacagcacgcttagattcttgatttttccttttcttgttataatagtatatgcacaggttagtggatttagatttagtttcgttatatagagttaaagatatctttagttaaagatagttgacatttttgtacactttagttttgaatactgaagaaatacctcatttctatgtgaataaattattcttcaattgagtagcaaattggatgcttagacattactaaaagttatttaaataatgacaccttattagtatgtttccacatacagatctggccattaaatattgatgagtagaacactgaccttagaatgtccaagttttcatgaaaatattcactaaatgaacaataggattagcaaacaaacggattattaaacctttgcaaatagattattaaatctttgcaaatacatatttttattgcaatactagcttgatcaactaatgatatgatttaaggcatataggttaaaatggggatagtttatggaaatgctactcacacatatggagtcatatgtaatttttaaagcttttaactattaaacaggcaaaataattggtgtgaatctagacattcttttagttagaaatgttataaattgatacctttcattttactatttatagtaaatgcataaagcccaaagtaatttctaatcaccttgcatgttcatgctcactatttatgtttacaataatattaatagcgtttgtaagactacatattttcttctaatgaaagcattatagaatcaattagatcacattgcaattagtgaaaaacactataagctagtgtgttttatactaaataaaaaataatgtgaccttgaggttacctgtcactactcaaggaatattttcactgtaaatgcaataaaagttaatacatgtaattacagagtgattaaacattatttattgttcatctttgagtagatttatctgttataaattgataaaattttaaataactgcttttttataaagtagtaagaatacaatagaaaatatataaagctttctatcaataacaaaaacaagtacagaaaaacaaaaaacctagtccatgtgtactccagccaaaggcagaaatccaaaagacacagtagcaaaaggtcatgtcaggatgctagctcaccatctgtagcagaaagcagagcctgttttcagtaaggaaaatgtatgtttaatgcaaagaacattatttctaacaagtaacttatcgggaatatggagccataaggagtttagaagtaaaaaagtcagcaataaagggcactggtgtccctaaaaggccatgattaagtgtctggctgaggcttctgcttgcacaggattttttcttccctctcttagtttgcagcacaaagactggccccactggaagaaaaacttgttatccatatagtgtatcactcagttgggtacagataactacatctcttccttgtgggaagaaatcctttttattaggctttgtgggcccattctttacttacattgtttgggtgccagttatgggaggccaggctttccctttcccactggagtcagcattcttcagggcaatcctcaaaactcctgcaagactccattcccaaaccagactcttctactctaacctgccaatttttaaaaaattattacagtacagcacattcaaatctaatgtcatgtttttatattgctgttaaaatctgaaaaagacaaaataacccaaaacaaaacttaggaaatatgaacaaattaacagcataatagaaatataaggcttttactatactaagtatttacttgaattgtttctataatcaatatattggcctgatgtgttagttacacttacacattcatttaacagatgacaaaacagatcaaattgctgagtgccccacacccatgagaaaccgaagctctgatttaaactcaggctgactccagaacgatactcctaaccacaaggatgtactgccttttcatttttaataactagtttcaaaactcagatgttcctagatattattcctactggcatctttctatttttgtcacttcctcagaatttatgacattttatatacatatacacacatacatatacatataaacatccatatatgtgtgtgtgtatatataatatatgtatacattatatatgtagtatattatataatatatgtataatatataggtatatgtgtatattatacaatatgtgtgtatatgttatatatacacatatatagatataaatacatctataatatacatatatatatttaaaaatgtatttgttcacctttgtgtggtgctcagaactgtgccttgtgcttttcatgtttgaacttatttaatcattagaaccattctgtgagagtgatattgttatcctcattttatagaggttaagtgatgcactgaagatcattgagtttgcatatggttgagcttggattaaaagacttttgtcccaatctctgtacaacccaaatgctctttactcttaattagatgtaacatgcttccttcgtttctcaagttttatctctattagttaactatacattatttaatatagggacaataccttccaagtcatatacaattcctatagcccctaacacagtaagagtttaatacatagttggtgaatttatttccacccttaggattcctgtcctggtttgtagaatctccagctgagatcataaatctcctcttaaatttactacaaatacttagactcctgaaaaatgtctcatgacgacaaacttcttaccaaggagcactgatgattttgatcagacccagagaatgtcaaggtgaagattgatacaacaaaatattgatgcccatagatgtaaatattgttgaccttcctatactttcaagtttctaccaataaatttcaaatcatgaacaatcttagaagaaatatgtcccccactcccacacaaatagcctttggctaaaaaattatctaggactgaggaaatcatttatggtttctttcttctgtccaccgccaacatatgatttttaaattgtactttacagcaccgcaaccctgattctttcctccattcattttcttttttaccctttggtcacaagggaaatctggattcttttgcccacctgaggcatctgttttctctttctatctccatgttttcatcatacttctcatgtatgttttacttccccttttttctttcacttggcattcctccctacatgggcattccagtgtgaaaccatagtgatattcaggcatgcaactaatgaagaggcagattcttatctgagcttttgctgacactcttagggaaagcttcatcgtatttatttagattttttaagatatagttgtttcttatcaatgaaagttatttttttcattttatattacagaagagacattttctactaaaaagagtgtaaatgttccctgccatcactgcagtttcacagaatagagatttgctgataaatataaccactaatgaggacacagattccaacccagagtagtaacagagcatgtaagctgacaaattccagaattaggattttttatagcataatggacagaagcaaaagattctatagaaatcaatttttaaaatcacttacttgtgctttgaccaattcgaagtgaactcaggacatacaaaatggaataacagacactggagactccaaaagtgtcagcattggaaggagagtgagggatgaaatattacctattagatatattgtacactacttggttgattggtccaccaaaagccgagacttccaagaagcagaaagtccaagaaagaagtgctgggaaaataatcaaaaggagcatgtagtggaataatatgaaaaggatcataactactacctaagctactggtcagaaatagtgaccagctgtaataaaagagaaaatgggagatagtaataatatactctctaaagtttgtatgacttcctctttattaatacatggagtaaaatctgtatcattctcattaccaaatgtaggtttattatttctcaggaatactttggtcaccttcttaagccccagaattaaaaatctcatcaagtgtcattcatttcttatatatctaagagtcaaattcaagcctattaatttagacccattataaaattgtaacttaatgaggcttattctgcttaggtatgtacctgtgttccagagcagcatgactatttcctttctctaaatacacacagtactttaaatgcctaacatacgattttgtaccctttatgttgtcctttgtatcttatgaattaatcctatccttgcaggtggtctgtgagtttcttgaaaatagggattgtgtattattatcatgcacagtaaaatggcacagtaactcatccaagcattcatatcataactaaatccctaccctaaaccaggctctttcaagagcaccatagaaatgtgaagacaattttaaaaataattttaggtgtgaattcttttatcttttgatttgatgttttcctttcatgttagacatccctcctatatcagagaaaggtgtagcttcctcctttctaaaaccagtttttagaactggctaagttcagtgctgaatttattatagctacaactagtgatctatggactagcaaaactctaaatgcattttttaaagcttagggggataaaggaaagaggaggtctctattggggatgattctgtcttctctaggagatggcttgaaacagaaaacttttatctatggcatcccaagaatatgaatgttatttctaaatatgttgttaaatagactttgattttgattacatggtttgaagaaagaaaaaaattctacatctacattttaaagattccagagatccatgtatatgtcttgagttttagagacacaaaaattctattccttagaccaacctcattttccagatgaggaaatagaccctcctgaattaattgctctgccattggtctcaaagacaggagtcaggacttgaattctcattccagatctgctatttatcatcttgcataaacgtttgacaagccaaagaacttttcctggattaattttcttaaaagattgtggagattgcttccaattacctacctgtgtgattattctaactttctattttacttttttacaatgggcccacaacttctattcgtattgtagctacaatagacgtattgtagctagacgtattctagacgtattgtagctacaatacgtctctttttagactagttctctacacagcacacacacacacatacacacacatgtacatactcacacaaatgcacatacagaatagattggagcccaactcagtatggcttgttgagttgacaccagtggtaacagtaagtatggattctccaagagctgaagcagctgtgacaatcttggacaaatgtaggctgtttgccacagtatgggtgggctacaccatcagcgctgccattagaatacagataaacattggccccagtttccagataattaggctttctgactccagctcacaagcatttttagttagttctcataaatgcaggtatatgtgcataaactgatgtacagaacttctttttgaggttttctgacgtcacttatccaagttttgcagttgtatgcgaagactatttaatagacaagcataagtagtttatagcggctcttttggcccttgtaaatatctttctctcaaagtaaactagcattttttaaatttttttctcactttggcacattttctcagcttaaagttagtattttagatttaagacatagagcttctgtaaagcataatttttttcacaatttctagtattctctaagtttgaaattaaattacccactagaatttcaacagatagaagcctggagccgccagtttgaaataatggtgtgcctttgtgaacacaatcactttttaaacatctctggtacagaacaagtaaaccaagcagcagacttattattagacataatagcagacgttcaggagaatagagagatgtccttggtgttttgtaattcatctgacttgctttttcttaaaagcaaagccattggctttatactattttaatatgtcatcttaggagtttgcaggcctgtgtttagcacatgtagaacataaacacagcagagattaataccagaacaatttaagaagttcagaggaggaaatcttacttgaaattcactgaatctatttgaagggaacatatttgcaatcaattcccaaggaaaggtgaagcagtggctagatcagcattgtttaatggtcatttctctcatagatgactctcacaaattttaaattaaaagaaaaatggtttgtaactgagcaggtatcactagcaactttccagaaaacttagttgtccaacgtttttcattgacttttcttatattagaaaatgaaatgtcagatgctattaattgcatttttacaataagtagctacatcaggagtaatggctaaacgaaagtacttcctgtctaatgcacaatagatatattcatttaaatgtattcaatttagatgaatgcaatatgtctatattcattacagttatacctacctgtgggctgaattgatgaggtggtaattactacctttataaatggaacagcattgtgagtctggaggaagaaaactcattttcttatcatgtttcacacacccacacagtagacacattccaaaatctttcttccaatcataaagattttacccttgaatttccagtggacctaatgattgtaaacatgatcactcagtaggtcctgcttttccggagggttgcaaagggttggtctcatgggatatgatggaggggaactgagagtctcaaaatctcttcatgcaaagtaagtctcatgtttgttattctgcatgcctgcagtgcagctgtagtcatcatgtggcatggatttgattattcttataccatacattgttttctgagttcaatgaaggtaggactattaaaatgtgactttgttgaatacttttatttttagaacactgttctaaaaatatagtctgctaattagaaaaagcaagtacacatagttcctatacactctgcccaaccctaaatagtttctcttattattatttggcattgtgtggtgagttagtgtattagactgttcttatgctgctaacaaagacatacccaagactggatgatttataaaggaaagaggcttaattgactcacaggtccacatggctggggagacctcacaatcatgacgaaaggcgaatgaggagcaaggtcatgtcttacatggcagcaggcaagagcgcatgtgcaggagaactcccatttataaaaccatctgatctcataatttatattcactatcacgagaacagcacaggaaaaacctaccctccatgattcaatcacctcccaccaggtccctccaatgacacatggggattattataattcaaggtgagatttgggtggggacacagagccaaactatatcattctgcccctggttcctcccaaatctcatgtcctcacatttcaaaaccaattatgccttccactgcccctcaaagtcttaactcattccagcattaacccaaaagttcaaatccaaagtctcatctgagaaaaggcaagtccctttcacctatgatcctgtaaaatcaaaagcaacttagttacttcctagatacaaagtgggtacaggcaatggttaaatacattcattccaaatgggagaaattggagaaaacaaagggggtttaggccccatgcaagtccaaaatccagtggggctgtcaaatcttaaagctccaaaatgatctcctttgacctcatgtctcacatccaggtcacagtgatgccaaaggtgggttcccatgatcttgggcagctccttccctgtgactttgcagggtacattccccctcctggctgttttcatgggcagacattgagtgtctgcagcttttccaggcacacagtgcaagctgttggtggatctactattctggggtctggaggatggtggccctcttctcacagctccactaggcagtttcccagtggggattctatgtggggggctcaaatcccacatttcccttcttcattgccctagcagaggttctccacaaggccccacccctgcagcaaacttctacctggacatacaggcatttccatacatcctctgaaatctaggcggaggttcccaaatctcaattcttgacttctgtgcatctgcaggcttaataccacgtggaagctgccaaggcttggggcttacaccctctaaagccatgacctgagctgtactttgtccacttttagccatggctggagcagctgggacacaagacaccaagtcccaagactgcacactggaagaggggcttgggcccggcccataaaaccatttttccctcctaggtctttgggcctgtgatgagaggggctgccatgaaggtatctgacatgccctggagaggtttttcccatggcttggcgattaacattttgcatctcattacttatgcaaatttctgcagccagcttgaatttcttcccagaaaatggggttttattttctattgaattatcaggctgcaaattttctgaacttttatgctttgcttcccttgtaaacataagctccatttccaaactatgtatttgtgaatacataaaactgaatgctggccaggcacggtggctcatgcctgtaatcccaacgctttgggaggccgaggagagtggatcacctgaggtcaggagttcgagaccagcctggccaatgtggtgaaaccctgtctctactaaaaatacaaaaattagtcaggcatggtggctggtgcctgtgatcctagctactcaggaggctgaggcaggagaattgcttgaacccaggaggtggaagttgcagtgagctgagatcacgccattgcactccagcctgggtcacaagaacaaaactccatctcaaaaaacaaaacaaaaaacaaacaaacccacaaaaatgaatacttttaacagcacccaagtcagcttttgaatgggttgctgcttagaaatttcttctgccagatgccctaaatcatctctctcaagttcaaagtttcacaaatccctatggcaggagcaaagtgctgccagtctctttgctaaaacataacaagagtcaccattgctccagttcccaatgagttcctcatctccatctgagaccctcagcctgggctttattgtccatgttgctgtcagcattttggtcaaagccattcaacaagtctctagaaagttccatactttcccatattttcctgttttcttctgagccctccaaattatttgaacttctgcctgttacccagttccaaagtggcctccacatttttgggtatctttacagcagcaccccactctactagtaccagtttactgtattagtctgctatcatgctgctaataaagacatacctaagactgggtaatttacagaggaaagcagtttaattgactcacagttccacatggctggggaggcctcacaatcatgacaggaggttaatgaggagcaaggtcacatctcacatgcctgcaggcaagagggcatgttcaggggaactcccttttataaaaccatcagatctcatgagacttattcactatcatgagaacagcacaggaaaaaacccacccccagtgacttgattacttcccactgagtccctcccatgatacatggggattattacaattcaaggtgagatttgggtggggacatagagccaaacaatatcagttagtatattgtagttgatgaacccgtatttatacattattattagcaaaatctacagtttacattaagactcagtctttgtgttttacagttatatgagtttttataccaccatatatatttcaggaattccagttctctcccctttagcatattaaataactggataaaaataaatcaatcaatcagtcaaatgtattcgttctttcagtcactacatttattaattcatgtattctttaatagacatttggtaaacataaactctaggtcaagaattcactgtaatttaattgcttcaagcgttttcccgactcaggcttaatatgcatattttttagtcactctttttccttcctcactcaaggatattgtctgattttactggtgagcgctgatatgttctgtattagagaaactgatagtctttccattttggtgggctaatactgcgttgtgtcagcaaaagttcattggtttatgtgtgttatatttactattttattgggtttttttttttttttttgagacagagtctctctctgtcgtccaggctggagtgcagtggcacaatctcggctcactgcaagctctgcctcccaggttcatgccgttctcctgcctcagcctcccgagtagctgggactacaggtgccagccaccacgcctggctaatttttttgtatttttaatagagacggtgtttcaccatgttagccaggatggtctcaatctcctgacctcgtgatccacccgccttggcctcccagagtgctgggattacaggcatgagccaccgcgcctagccctgttttattggttgttaagcaactctgcaaaacaatctacagcctttataaacttgtgcaatgtagcatctgtatctgatcattaagaaatctggaaattatatcttccctctttttccttccattagacagataagcatgattaagcgattaagcaataaagcagtagctgctgttatgattatctttggattcacctgcacttccttatttcctttctaacttgtttttctggtggaggaactgtatattaattcatgctgaggaagatgaaattggtggtggccaacgttgataactgtggtcctaacagaaatgcatgtgttcctaaaaaataatccctgtttagactgggcacggtggctcacgcctgtaatcccagcactttgagaggccgaggtgggtggatcacaaggtcaggagatcgagaccatcctggctaacacggtgaaaccccgtctgtactgaaaatacaaaaaattagccgggcgagctggcaggcccgtgtagtaccagctattcgggaggctgaggcaggagaatcacttgaacctgggaggcggagcttgcagtgagctgagatcgcgccactgcactccagcctgggcgacagagtgagactctttctcaaaaaaataaaataataataataataataatccctgttcaattgcagtcagttaagaaacatctccaaaataggcaattatttaagcaaactttaaatatttaattgtttcttcatgtacagaaatgtagtcaacagtctggcatcctgcctgtaagtcagaaatttgtcattctttccaaattagaaacaatgctgagttgtccctagggaacgccaccgagagacaatttcacatgtttaatgtgcttttatttatcttttaatgtgggcatctttgatgaatcattaataggaggagaaaaaaatccctttcaaaactagttagtggctgacatcacaccttacctgggcattgatggaaaagtcaaattttgtttatgtctcattccaagtctggctaatggatagttggttcacactgaactataagaaaaacaattgattatggtaaaatgggaacagcattggaaaacaagaatctgcagttctgattatggatttgtgtgcaattgccactctccattactttaggaaaactcttcaatatgcaacatagatctcagaatctacataaaaaagattgttctaaaagtctaaaactaccatgtgtttggaattatacttacctacctactctaacattattccaacagtctaattctccgtgatatgaattgtgttgccagggtaggccatactgtctatgtgtgtaagagaaaagcattctctgcctttttattattattattaatttcacttttcaataaatagttactgagtttttctaagtaataagtaccatgttagatgttgtggaatgcaaagactatcctttttacaaaagaagtcaatcagcccagcacggtggctcacacctgtaatctcaacactttgggaggctgaggcaggtggatcacctgaggtcaggagttctagaacagcctggtcaacatggtgaaaccccatctctactaaaaatacaaaaattagctgagcgtggtggcatgcacctgtagtcccagctactcaggaggctgaggcaggagaatcgcttgaaccgggaagcagaggttttagtgagctgagatcatgccactgtaccccagcctgggtgagagtgagacttcatatcaaaaaaaaaaaaagaaagaaatcaatcataactttggagaaatcaacattagtaatattaatgttaattaagtacatattatgctctcttgactatgtttggaattcttaaataggtaaaagtaaaaaaaacagagattaaaaactcctgaaaaccctaattatgcaaagaaaattaaatttgctagctttatttttatttttattttacgttcctgggtacatgcgcaggatgtgcaggtttgttacataggtaaacgtgtgccatggtggtttgctgcacctattaacccatcacctaggtattaagcccagcatacatcagctgtttatcctaatgcactcccatcccccacccaacccctggagaagccccagtatgtgttgctctcctccctgtgtccatgtgttctcatcattcagctcccacttataagtaagaacatgtgacatttggttttctgttcctgcattagtttgctgaggataatggcttccactccatccatgtccctgcaaaggacatgatctcattcattttcatggctgcatagtattccatggtgtctatgtaccacattttctttatccagtctatcactgatgggcatttgagttgattccatgtctttgcgattgtgaatagtgctgcaatgaacatggtatgcgtgtatttctgtaatagaatgacttatattcctttgggtatatacccagtaatgggattgctggatcaaatggtatttctagttctagatctttgatgaattactacactgttttccacaatggttgctaatttacattcccaccaacagtgtaaaagtattcctatttctctgcaaccttgacagcaactgttgtttcttgactttttaagcatctccattctgactggtgagagatggtatttcattgtggttttgacttgcatttctctaatgatcagtgatgttgagctttcattcatatgtttattggccacatgaatgtcttcttttgaggagtgtctgttcatgccctttgcccactttttaatagggttgtttgtttttttcttgttaattcgtttaagttatttgtagattctggatattagacttttgtcagatggatagattgcaaaaattttctcccactctttaggctgcctgttttctctgatgatagtgggttttttgttgttgttgttgtttgtttgtttgctgtgcagaagctctctgattagatcccatttgtcaatttttgcttttgttgcaattgtttttggcaatttcatcatgaaatctttgcctgtgcctgtgtcttgaatgctattgcctagattttcttctaggatttttgttgttttgggttttatatataagtccttaatccatattgagttaatttttgtataaggtgaaaggaaggggtccagtttcaattttctgcatatggctggccagttctcccagtcctttcccaattacttgtttttgtcaggttcattgaagatcagatggttgtagatttgtggtcttatttctgagttctctattctgttccatgggtctatgtgcctgtttttataccagtaccatactgttttggttactgtagccttgtagtatactttgaagtccagtagcatgatgactccagctttgttcttttagcttaggattgtcattgctacacaagctcttttttgaatctatatgaattttacaatagtttcttctaattctgtgaagaatgtccatggtagtttaatgggaacagcactgaatttgtaaattactttgagcagtatggccattttcatgacattgatttttcctatccatgagcatggaatgtttttccatttgtttgtgtcctctctgagttacttgaccagtggtttgtagtcctccttgaagaggtccctcacttcccttgttagctgtattcctaggtattttattctctttgtaaatttgctagctttgtatgagatagtggactaaaggtgataaaaattcctctcacctgcccaaatttccatcaggaatttgctttgtagactcaggggaaaatagtattttgtgaaaaataattttatagtgtcacatgcattcagtgatacacacacacacacacacacacacacacacacacacaaacagactgcagaacatccaaacattgagtacctatataggggaagaaaaataattttcttcttctcaagcgttctgctgtgacttcctgtaacaaaagacaaattaacaagataagaaacagaagtttgataacatgtatacctcttgtgcacatgggagataacctggagaaataaataaacttatagactaaatttcaaacaattgtcttagacttcaggcttaaatatcatcattctccaaaacaaagaagtacgcagtgaaaggtaaggtaagtacgcagtgaaaggtcaggttaagacccatgaaaagtgctactacaaaacaggaaagtgtttgttatgcagatttaaatctatgccttttccattgattaagagtctctagtaatttagagctagccctctcttaggttgtcttaggtgtcttaggagacacctttacaagtaaagatttcctttataggtgtaaatttatctagaaaagggtaggtaacttttcaaaccttctcctgtgtctataatttcttaaaataactagttcacaattatccttatgctaaggaggcatactggagtggcatagttaggtttcctacagtcatattttggggtggcatattctgagccccatcacctatatttgccatgtggtatacttagtacttccctaaaaattatccaattttttcttcacaacaatcttgtaagctacttattattatcccccttaatctattctgagataactgaaacctgtagagtttgaacttctgtaagacagaggctgacattcaagctagtcaggtctcaaagacaaagatttttttttcctattataaaaacagaataaataagtaaatgaaacctccaaagcaagttttctgttatccaagctgttacagagatgcagaaagatgatggatgccaaaagagtgttctgactcagcagcagccacttgattggaagaggggaaaattcactctctttgaagtaggatttcatttggggctaatataatagaacgagttagagaatattagaattcttaaagcaatctcttacacataacagtgaagggtcaaatgtgggctttcatgcaaagaatatgaattcaattctcacagctctgtgctggtattacccataaggagctatgaagaacagcaattgatttcttccctttcttttccataatcagagcacatattcacaaccaatgcaacaagactactaccttgcattttcctagtacccatctctcagcttcaagagcattatgcatttttaaaattataattagttctctcactcttcctgggagttaactgctccatatcatcccaaacccacaaatgagttagcggagacagcctggagttatatggcatctggataaatgcttagcaattggaacagccttgagtatggtgaatcacgcctctgaagtcaggcagatctgagctttaatccagtgaatgaatttctaaacatgtttgtgccttattttccatatctttaaatgagataataatagaacatacttcatagggttattgtgaagattaagtgggtgaacaagtgtgaagtgcttggcacatttctagtttacaatgtagttcatgaggagttaatgtgtaataattacaataatagtaacaatttgatagcaaacattcatatttctaagtgcattactctagtcaacactagccactttaaaaaacatacgtgttttacgcattaatgtaaaatttttggtgtgaaaaagtacatattctctccttgtacccaaaacattaattataaaaagtaattaaatactacagaattcatactgaatgacaacaaaaaatgcccattggcattaccgaatgttttaaaaatgactcttgttaagataactgtcatattcaatattcaatttgtaatttattttcaacctttaatgaatcattgagagtgattaacaagaagctttcttttatgtcatacattttttttctgtcagataagctttcaaaacctcttcctctaggcaaactgtaagaagggaaatttaaataactggcaaatgaatgaattcattatatatcaaatcttgtatctataattctttctttattttaaaactttactgatactgagaataggtcatcattttttactcctttcatatatgacacttcatctctaaatatatttaaagattgtgtaattatttcagagagtaaatcgtcttatttaccttcaggcctattttttcagtaaaagtatcctgtcattcaacaaaaagccaagaaatagtgtgtgctaataatgtgtatataatgctatgtgagagagacattaacttctaattattcttaagtagtctgatctaggtaacccttaatagcaatttgtgattatcactctatcacaacttatagtttttacctctttacatgtaattctttcccattaaactgtaaactaatgagtgtaagacccagtaagaaattgacatttagaagttgctaaataagagattcttgaatatatgaatacttaataaacagttgaatgaatggatggttacatgtgtggatagatcgttggatggatgaggtagcatggagacagtgaaaagcatgcccccctttaccattacctagccattagattttatacaaaacatgaaattactaaatatcagttgcctcttttgaaaaataatagagatttctatccttataattcagtctatgtttgtatgttttgtggtagaatttatactcctcctgttcactctttctctcttaataaagaggccagaatatgccctggagattgtcattagcaccttagaggtaagaaagataagaatatctgcataatttcctggcaagaataatgaagcaagaaatgtgatatgtagtttagtctaacgaccttgtaaaatataagtgttcagaaaaagatggtattaaacttaaattttggtgaagctgtcttaaaattgtaaaattttgaattaagaatcatcaatatgatacttaaagaacgttttagaaatatagaatgtttagatgaaggtaaacattcactcttgaccattgaactactgtcataaaatcacctacataatctgaaagaatataaaaatacatttttagcctcaaatctatcctgaattttcagttgttcccctacaccagctcatgaggctaaggtatttttgagcactaaggcagtgttgaccaatgtctaagaacattgtcagttttctaaggctgctgtcataaggaagaaagaagaactatgattaggccgggggcggtggctcgcgcctgtaatcctagcactttgggaagccgaggcgggcgcatcacgaggtccggagatcaagaccatcctggctaacacggtgaaatcccgcctctactaaaaatacaaaaaattagccgggcgtggcagcgggctcctgtagtgcaagctactgcgggaggctgaggcaggagaatggcgtgaaaacgggaggtggagcttacagtcagccgagatcacgccactgcactccagcctgggcaacagagagagactccgtctctaaataaataaataaataaataaataaataaataaataaataaataagaactatgattaaaacaaaggaatccctagtttcaatccagtccctgtgattatactaagaaaggacatgaaaaataaataaataaataccggctgggcgtagtggctcacgcctataatgccagtgctttgggaggccgcggcaggtggatcatctgaggtgaggagtttgagaccagcctagctaacatggtgaaaccccgtctctactaaaaatacaaaaaaacgtagctgggcgcggtggcgcgcgcctataatcccagctgctggaggggctgagacgggagaatcgcttgaactccgggagggggaggtcgcggtgagccgagatcgcgccattgcactccagcctgcacgacagagtgaaactccatctcaaaaaaagaaaaataacttagtgagaaagagtggagaaataatggtttcccttgattctaagtctactaaatcaagggatttagcaccatctcaatgctgtattcccgtctcacttctcaatagtgattgtatcagctggcaattttcctagttctttcaacaactgggttttgaccttgaaatcagtctccattctcattactggctacagcctgtccactaattttttatatcctccattattctagaatgtaaccaaattcttactttaactctcttaggtaggcaatccatatacttggtctagttgtgctgttagttaatggtatcattcccttctttctttttgccatgtgttttaccctcttatatttgggcttaaatcattatgttacacacgtctaaattaattgtcccattacttcaccccattctgaaaatatgcgtaaattatttctgcttactttcttttctggtcagctatttgcctatgatgtacacttatgacccgatttctttctattgagggtagtcgttttggagaaacaaagataaaatccattctttagtttgttcattcattctttatacatatttacttggtattctcaaagtgccagtcactcttttatttggtattgggataatagagcagaagttatagaatggtatgaggcataaatatataaaccatgattatccattaatttgcgtagtgcatattaagtagcacatattctgggctagacaacatgttgtttagtattgtgtaacaaaaatgaataaaatagcttcttccctcaaaaaattggtggaataaatagacatgaaaacagataatttaatgctatgtgacatatctggtaatagaattaaagaggaaaatatagaagcagggtttgataaaatatgatacaggcaaggtaagaagtttttctggtatattgagaaggttggctttaaaggaatatagcaaatcacagctgtttactaacaaaggagccaggcataggttgtttgaattcaaattccttctccgcttgttaacttggagcccatgagtgtgtaatctctctaagcactggttgatgcatctataatgcagactaaaatagaaccttactcatagggttgttgtgaggaatgatgagataattcatacaccttgtgcatagtttatactcagtaaacatttgccactattattctataatcaaagagattctataatcaaaagaggattttaagcaggagaattatgtagccaaaactgttttaagtggagcatactacaaattttcaggagaatattttgaagaacatggacataaacccattggtaatgtgcagcaggaactgatgcttgtggaggaggctttggcaatgttgaacataatggatacatcaggctctatctatagtgtgaatggggacacccatgggagagcatatgaaatggataaatcatttggctgaagatagaattgcataggacactaaaatttaagggataatatcagaaaaacagagggctatggaggatataaagaagaatggccagtgatgtgcttggtaataggcacaatcacaacctagaaatgggtggcaagaagaaggatgaggaaaaaccaagctccagaccagggctactttagaaatcatgatatgtcagttgataagttagggatgatgcaaaactaaaagttattctcacagtgtcatgaattcccagaaaacaatgtgctccgtcatatttctttaagttaaataccaccttgattaatacgagatctggttatgctattagagagaagtctaaccaacatttatgtattttttcttaaaggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcaggtaaggcaaagtgggaaaagtccttcatattcctgtatttataccttcagaacagaactgtatgaatttgaccttatttactgccatataagactgtgaggtaagaacattttatgtcttttttcccccctggaaaggttgtgttttgtgtttaaatgttatccaaagtcattttttcctagaactactataaagctggaggtaaacttagagataatctgagagtagactgacatatttattttagaattatattcagttaacccttaaacaacacagtggttaggaatgtcagtcaaaaatccacatataacttttgcagttaaaaatctgcatatgatttttaattccctcagaaatttactaatagcctactgttgaccaggaagaagtttactgtaacataaacaatccattaatgcatgttttatatatgttacatgtattatatactatattattacaataaagtaagccagagaaaagaaaatgttattaagaaaataaggaatagaaaatattgttactattcattaagtggaagtggatcatcataaaggtcttcatcttcattgtcttcatgatgagtaggctggggaggaagagaaagaggaggagttggtcttgctgtctcaggggtggcagaggtcaaagaaaatccacatgtaagtggacccattcagttcaaaggtcaactgtatgtagggaaaccaggacccaggaaaaataatgtcttattcaaagttacttaactagttagtgacagatttagaatcctggactagtactaggacagaatctattattatagtctacatctttgttcaagggtcaactgtatgtagggaaaccaggacccaggaaaaataatgtcttattcaaagttacttaactagttagtgacagatttagaatcctggactagtattaggacagaatctattacagaatctattatagtctacatctttcaaggattctaagttataggaaatattaggtctttgggaaagcaattctcaataaaagattacattttcctaagcatactctcttaagaaagtcaaagttgttatttaataaatgaaacattgaaaacaggcaaacaaaaaatccaaaagggaaaagcctaggggtaatcacaggtgaaaacatttcagtttatttacttgaaagatcatatgggcatctatattattagtgtggatatactacatatggctgcctaaattacctactctccaaatgtgaaggaagaggctattgttctcatctggttagatgttatccttgctgattgaggtatggcgatactggcaatttaggaatgttaaataccaccgactgagaaaaaaaatttcatgtggccaaagattattgctaacagctgtaacaaggtacacattcctgataccaaatggacctggcatgttggaatgtgtgggtaagtcttgtatactctatctcaaatatttattcagattaaacaaaaataaatctttcgtcagacatcactagcattatattgagtgtatactaaatatatatgtatatatatgtatatatgtgtgtatatgtagtatatgtgtgtatatatgtatatatgtgtgtgcatatatatgtatatacatatatgtgtgcatatatatgtatatacatatatgtgtgcatatatatgtatatacatatgtgtgcatatatgtatatgcacatatatgtgtgtatacatatatatacgcacatatatgtgcatatatacatatatacgcacatatatgtgtatatacatatatatacgcacatatatatgtgtgtatatacatatatatacgcacacatatatgtgtgtatatacatatatatatacgcacatatatatgtgtgtatatatatatatccttgggaaatgccagcctgacgaagacacagcttttatccctaaacgtaagatatatgtatatagttggcttcgtttctctgacaagggcaagataatgagataaactgttttaggattgtaattcccaaatcctagtgtgcataacaatgacctcagaatatgttaattgttcagattcacagaatcttcctcagatattctagttcaataattctgagataggatctagcaatctatattttaaaatgaattgaaaatgaaaaatttcaaacgtatataaatgtgaactaatggctatcacccaacttcaatgataatcaatcttgcttgatttataccatcatcgctcaccacacctccaccattgttacattattttgaagcaagtgccagatggtatatcattttatctaaaagtatttcaagatatatggtcatgctttaaaattgatgctttgattattatctaacctaaaaatcaacagtaaatttttaaataccagttagtgctcttgttaccttagtggtcttataaatgatttgtaaatttgagttcattgaaattaggatccctaaatatccacacttttggttggcatgtcttgaagtttattttggtatattttaatctataggtttttccatctcttttaaaattgtacattttgcagttccttttcacatttgggattatgcaaaattctactcactgttatctttcaacattttccttggtttccttttcactggtttttatggatagagatttggccaaattcagacatatttttttcatggcaagaatatattagagggtattttgtgtccttccataaggaggcatataatgtctggttgtctctctttttataatcttaagtttgatgagtgagttgaggtactatcagattattgatccatttatcattaagtttccactggcttttttctcactaatgatttcgtagacatcaatgatcatttgctcaaatatctttatttgtatttataaaatgatgattcaaattcttttacccctgctacatatattagatagattacgtctgtaaagagaaacttcttataagcaccaccgcctgtgggattttatgcaggtggctttcaggctgaatattaagaaaaatttattcagggatttggagaaataaaagaccaggaaaggtctcatgcaacagtggaatttgatttgtgccttacacacgtataaatggatgttaaaatagaggatcaaggtgagatggcattcttgtcagtgggaatagaagctaaggtgagaaaatcgaagagcatgaggcatcttttgagaactgtaggaagtattgaactacctggggtgaatcttccatatcaggtctgcatgccacagcatcccgtgtactctggaatcctgcctaatcaatttgtttttttatcattttcttcaatcttatttctattagctatctaacatgttgataaacaaccttcctcaatatttctattctattctattctattctattctattctattctattctattctattctattctatctatatgcacacttccatctttcatttatttgcttgtttcatttgtttattgactttctgtcattctaactttcctgggtattctccttcattaaacaatgattcggtttctactgtgtgctactgtgtccattgtgaaaaagcgacacatttggcttccaccttcagggagctggtaatctaaatgaggagaagacaaatcagtagatcttgtgatacattaatttaagtgttgtaaaaattttatacgtaggacacttaaaagagagcacacaaaactgattccagaaagaagagaagataaatgagctggatttcttaaagactgaatagaagctaactgtgtactcaagaataataggtcctatatggtagaaaacctattatcaaggcatgggggcagttaaaaagcgtaatctatgaagaagcaaatgattcactatggctgcttaaggccatcatcactatcttggggatcactttagaaatctttgaaactgcatcctatttacctctgctttttgcagtgcatcttgtcctcatttttcattttgcattctcatttccaccatcataattaatctcacttctaaattattgctgaggtcttcaaactggactccccacctccagtatttttcctgttccacaccaatccatccacttatgaccagataagtcttttcaaactatcccatttatatgatcactcttttcctaggaaatctttagtgcttgatgactgattttggaaagggtctgaactgcttatcatgctattcaaatccacaatctggctcttgactccgtttccagatttatcttctgcaaatccagaatttccttacagtttcttcaaacatgtcttatgctttcccacatgctcatcttggatcattatcttctctctccctgaagtgccctcttgtcttgtgtctctttttcaacacatacttctgcatatttaatgcagaaattgacaacttatatgggatattaaaatagctgagatttcatggtaaactaatttaacacagaattttaaaaataccttttgcttgaaatctattaatattattgagaatttttgtatacgcttcccactttaaaaaacattggaataattaaatttgctataaactttgttagactgctttcttggataatattgaaatacttccatttaaagatttattttagcccaaaatattttgaaaattacctcaattttggatgaagctgagttacactgaagtaaatcatgcaaaagtatatattttttcaaatttcaaagctaaatctgtccatttggttctttcttctttaagagctcttcttgattatgataatgattataatggtggtggtggaaatttggctattttttggcctgagtaacgtgaacagttgccataattttactttccatgtagattcagatgaactagctggcttcttctgttgaccttccaaaaatatgctctttttggtacacttagaagtaaatccaaatgctcatgaaatccattctattactcatcaatagaacatcttagatctgataacgaaataatctatgaatactcttctctgcttttccttcattcatgtataattactcaggatcccaccgcttaataagtaatttctgaagcatttgttattatcgtctgtcagcatcatgtgtttattttatcacaaagattatattttcatggttatattgtaattctagacgagtaagtcaacacacaacttcaagaaataaagtaaaagagtatgtgatacatatatttaaatgaattccattggagctttaaaaatatttttctataatttgaataaaaattaagattatttatttatttatttatttatttatttttgcctcatggcactccactatgggcaacacagtgagacctgtctccaaaaaaaaaattaagatattttcttaagtattatttgtagagaaaggcagctcatcaataacacacctgattttttaaatttcttcagtgaggaaaaataatgaatttctagctttgacaagccactctatatatagctcacgtttttggaaacaactcaatatcttagctattgccttgaacttcttaaaattctgtgtaaatgttgagtattattcctaatgcagtttgaatgtgtatacaaattataatcacttagataaagacagaactgtaactattaatataggtaacatgtcaataacagctaattccttgtgagactacctagaagtcataatccctttctcaagattgttagctgcaaatgtattactgggatgaataatacacatcctcacatgcagcagaactctctcctgccccagggacattctgactcatctcaattttgaaaaaacaaatgagccagatccctgtacaattaacccataaaaaatatctttaataataaaaaacaaatccactttgaaaccctccacatgtgacgcttcatccttctaatctccatttgcttcacaataggatttatttttacccagaaggagctgttcacttgtcaagccctggatttgaactccaacggattcattgtttaaaatactgttttggattcaccccatctctacttgctctggataacatatcaaaacagaactaccattgtcatcttgaccttaagaggaaaataccccaaaattgctaaaagaatttaatctaattccctttttttgtttctgcaatttgatttatattttccccaaatactgcccaagtgatatatagtatgtttaagttattagtcctctaaaagtgctaacaaaatgtcaaagtgtagatgagtggtagggtcagcaacattgaagaaataaagactggagtgcctggaatgaataccttcagtaccataaaataatactctctcctgttccattttgcattctgtaaaccaatatttctggcaaagtatgtgtgtgtgtgtgtgtgtgtgtgtgtgtgtgtgtgtgtatgagtgtgtgtgtgtgtgtatcctggaatcacccagcagtagttgcaacctttattagcagagaagtataagacaaaagaaccaaaggtgatcttagcttcctgctcctatttaactctcccaaattactgtctgtatcttagccaagaggctttttgctctcaaggttctccttactgaaaaatatattaaaaattctgcattctggctccttctgacttccagatatatcaagtagtttccttctaccttatgacactggctatagctgactgttccctctgtctggaaaattcttctatctgaccttcagtgttctcgttctcttcatttgtgtctcagcttagatgtcacctcttcagtaggacatttcccttttaccttaagtagtcagttaccaattttccagttctaatgtcctgttgccactatcagtgggggtgtaccttgtaatggccagagccagctgttcaatattcaagaactttgtgagctggttgtttaactattggtagattgaaatcagccataataggatatctacaaacactacaagtcagggctttctgtgttttgtttggttttttgaaagagttgatagaccagcagaaaactgcttattattctttaaaaagaaaaaaaattactttttaaattttgtcctcatactccactcccagctattaaccttataaagggaagggcatggttctattagccactgtgtctctagaacttagagcaatttctggcacatagtaacattcagtagattttttttaaatgaaaaagtagctgaataacttggtttttagagtagaccatttcactctgtcctatgtcaatacattgacctatcattgactaatcatttcttaagtgaacagagtaaatactgtggtaaacatatggggtgcctaatctcaagttatttatgattattgaacaaaaggtgtcatgaaatgacatttttataatttaagaaaatatttgatcccatattattgttgacaaggtgtgccaccccagtatgttcagacttgactttgtggaaaattgctaatcttcaaggacttttaagcaagcaaatgatatgactagatttgtgatttagaaaaataatcctaaaagcagtttatgttggtacacaagaaggagagcttggctctgtgatgagataagcgttcaagagttcaagagagacaataggagtctttataacaatgacaatgagggaagagaaagggatagattctaaaaattgtcaatggattacaaaatgtgaacacatgttttgcataactagtaatcaactaatacaaatttgaagagattttaaaaggtaaatatgtcaagcgtgaaaaaaagaatcataccacccggtgttgacaaggtgtgagaaaacattgcttatgagagtataaattgtcttaattcttcagcgttccacttttgattattatgaaaaggcttaaatttaaatttttcttactaacagttccatttggtaagtatcctaggaaaataatcagatgaatttcaaatatttatgtataaggatatttaaactagaaaaatactagaaacaatctaaacatacaatgaagagagagtggctaaattatggtggacttaaactggaataatatgctagaattaaacttaatgttttgggtctactaaaaatagatgatgtaaaatgtaattcttaaaagttattattagataatttatgttaaaaatcaagaaatacagaagtgtagaaaaatatttaaaattatttaataataatttggttcacatcttttcagataagtctctaaatgtttactatccaatcacaaactatgatgtaacaacataaaatgtggttatgctatacataatagtcttcatatattttcacttaatgttatatctcataagtccatagagatctatattttattgtgttgttaaataaatactcggaatttacattattgtgacttgtaaatatttttccaactgagcttcataacatactatgatgactttatgagtatatcttcttcctggagttagaaattgcttgactcttatatttcatcaattttgcatcactgcctattactcattctttcctgaattatataccatatataagaacaaagtttcattaaaaacatcacataagtcagataatcaattagtcctttctccctcttcccttacacatatatagtaaaggcctccgtctttctgctccaatcctgacaatttgttcatcaggtcagatgcatagctattgttctaggacttattttcaccattattttgtaaatgcttttgcttctatcctggattacacttcttgtttccttgatcccatggctatgttttctttatttcctgattttggtggaacctatcctctagggcttcctaacaaaggatacatatgagataaaatttggggatccttgtctatcagtaaatgtgtttattctaccctcgcagttgatttattttcaaactgagttgtaactttcagttttattgttgagaagctatatgccatcttgtatcctaattgttcctttcaggaaacctttaaacttttcatcatctcttcctacaacaaaaattggtctagtgccttctgtatgcccagcaccattccaaatgctggagattcattatggagtgaaccagacaatcatctccatcctcatggagctaacattatagagagtgtataaaaaagaaagtgaacatataaaatatgaaaaaatatataggatatcagatgttctacatgctatggagaaaaataaaggattgaagtgtacagagaatacagtggggtaaatagcattttcattaggggttttagtaaagaccttaattaaacagcaattatgaacaagggcctaaaggatatgaaggagcaacccatagagccatctctctgagagagagagagtgttccacacagagggaatgccaaatggaaagtttgggaaatagggccatttagtgttccaaatactcctaacacattaacagtctagaacaacttgcctttggatggctttccagttattgtgcagggcattccatgagatctctcaacagggaaaaaaatatgtcatttgttttagaaaagtggtattttaatattatttctttgataatatcttcctctacaatctatttctctgttttctttcaaaatctgaatacacaattaaaagacaaagactgtcatagtgtgtccagaattggcgggttcttggtctcactgacttcaagaatgaagctgcagaccctcgcggtgagtgttacagctcttaaggtggcacgtctggagtttgttccttctgatgttcggatgtgtttggagtttcttccttctggtgggtacgtggtctctctggctcaggagtgaagctgcagaccttcgcagtgagtgttacagctcataaaggcagtgtgtacccaaagagtgagcagcagcaggatttattgcaaagagcgcaagaacaaagcttccacagtgtggaaggggaccccagcaggttgccactgctggctcaggcagcctgcttttattctcttatctggccccacccacatcctgctgattggtagagccgagtggtctgttttagcagggcgctgattggtgtgtttacaatccctgagctagacacataggttctccacctccccaccagagtagctagatacagagtgtccacacaaaggttctccaagtccctaccagagtagctagatacagagtgtcgattggtgcattcacaaaccctgagctagacacagggtgctgattggtgtgtttacaaaccttgagctagttacagagtgctgattggtgtatttacaatccctgagctagacataaagattcttcatgtccccaccagactcaggagcccagctggcttcacccagtggatcccacaccggggtgcaggtggagctgcctgccagtcctgcaccatgcgcccacactcctcagcccttgggtggtcgatgggactgggcgctatggagcagggggtggcactcgttggggaggctccggcggcacaggggcgcacggagcaggtagggggaggctcaggcatggcagactgcaggtccggagccctgccccgcgggaaggcagctaaggccgggggagaaattgagcacagcagctgctggcccaggtgctaggcccctcactgcccagtgccggcggggccggccggctgctccgagtgtggggcccgcggagcccacgcccacctggaactcgcgctggcacgcaagcaccacgcacagacccggttcccgcccgcgcctctccctccacacctccccgcaagctgagggacccagctccggccttggccagcccaggaaggggctctcactgtgcagcggcgggctgaagggctcctcaagtgccgccaaagtggaagcccaggcagaggaggcgctgagagtgagcgagggctgtgaggactgccagcacgctgtcacctctcaatagttcacaaaaaagactcaactctgagatgtctacaagaaacccacttcaaatataaagaccgattaaaagaaaactaatagagaaacatgcaccgtgaatactagctggaagagcagcattaatttcaggcaaagctgagttgagcaagaagcaaaattttcagagataaagaggaacattgcataatgataaaggaattatgtctccaagaagacataatcttttatgtgtatgtattcaactcacaacagagcatgaaaatatgtgatgcaaaacctgatagaaatgcaaagagaaacagatgaatccactattttacttggagataccaatacctgtttgtcagtaactgacacatctagcaggcataaaatcagtaagaacatagttgaactgaacagttacatcaatcaattggatctaacttatatctatagaatacttcatccaacagcataagagtatacattcgtctccaactcacgtaaaacattcaccaagaaagactaaattatgattaaaaaatacacattaaaagtttttaaataaaaaatcatacaaaatatgctctcaaatcacaatgtaattaaactagacacctgtaataaatatttggaaactcacaaaacccttggagattaaaaacacacgaattaaataaatatcaaaaaagtacaaatatttcaagccaaatgaaaatgaaaatatgtcttagtaaaatttgtggaatgcggcaaagagtgcttagaaaaaattatagtgttgaatgttatattgaaaaaagaaatatcaaaaattgataatctaagatcttaccaaaaaaactgcaaaaagaacagcaaattaaattcaaagtaaacagaagagataaaaattagagcagaaatcaataacactaaaaataagaaccaatggtgaaaatcaatgaaactaaaagctgactctcttaaaaagatacagttaatgtatctttaatcaggttaactaaggagagagatagacatggggagggggagagagagagagagagaatgagcgagttaggataataaagaaatagtataagtgactctgtccccccaaatttgataactttgatgaaatgttaatttcttaaaagacacaatctatccaaactcatacaagaagaaaacagattatctgaatattaaaggagaaaactaaagttggtgagctaacacgatccagtttcaaaaagtactataaaactaagtatgtaaataagtaaataagacggtatggtatcgtcaagagaatagatcaatagatcaacagagcagagtagaaatcccagaaatagacatgcactaatatagtcaactcttgctctttgacaaagaagtaaaggtaattccatggagaagatattctgttgaacaaatggtgctgaaacacctggacatccacatacatctgattttctaaaagaagctacaggccttttcctaactgtacattattcaatcattatagtatgtgtgtagtggtatctcactgtgatttgttttgattcctccaaaaactaataatatgcaacatattttcatttgcttatttaacatttacatatcttctttggtgaagtttctattcacaaattgtgctaatttttctaacttggttgcttgccttattgtttaagaatttttacagttcttcatatattttgaatgcaaatcctttatgagatacaaggtgtataaatattttctcccagaattgcaaagtatttttatatttctctgaatattttataattttagtttcctaatataggtctatgatctaattttgagtattaatttttgtgcatgatgtgaggcaagggcccaagttcaatttttttcttatagatatccagttgttccaacataacttgaggaaaatgctatttgtgtctcatggatttactttggaagcactgtttgaagattattattcataaatgtataagtttatttctagattctctatttcattactttgacttatatgtttatgcttatgccattaccacgctatcttatttgctgtaactttatagcaagttttgaaattagatagtatgagttctccaaatttgctcttgtttttaacaattgtcatagcgattctaagtcatttgaattttgatataacttttggattctgtttgcaatttctaaagcaaacctatttggattttgataggaattgcactaaatttagattaatttgatggaattttaatccttaaccatattgagtctcccaatttatacatatatgtctctgtttacttaaattgcctttaatttattgcagaaatcttgtgtagtttttattttacacattttttcttgttaaatatgacacatattttagtgatttttatgctatttgaaagggaattttaatttgactttctgtttgttgccactacatgaatatccaatagattttttatattaatattactattttatatcgatcctgtaattttgttcaacttggttgttagttctagcatcttttttgttagacttttaggattttatgtatataagaacatgtcatctacaaataaagccagtcttacttctttctttttgagctatatgcctgcacttatgttctttcttgcacagaattccaatgtggtgttgaataaaagatgcagaaatggccacttttgtgttctgaatcgtaggtagagataattcttttgacattgagtatgatgttagttataagtttttaatagaaaccctttatgagaatgaaagcattttttttactcctagtttattgagagggtgttttatttattttgaaattataaacgggcttccgtttagccagatgcttttttttgcatctactgagatgaatgcgtggtgcttgctctttattctgttaatgtggtataagatattaattgaatttttggatattaattcaaccttgcatttctggagtaaatctcactcatggtggataacatcttttttataatttataggatttaaaattgatgatgatttgttaaggatttttgtgtttctgttcttgagagaaatatagttcactttcttgagatatgtgtgtggctctggtatcgaatactagaattagaaatgagtgggaaatgtttcttgctcttccaattcctgagtttctgtagagttattattcattctttaaatgtttaatagaatttaccagtgaagctacttttaggtactcttttctttacttactgaaaatttattgagatcattctatttcttcttggctcgattttggcaatttctgtctttgtgtaggtattgtccagttcatgtatgttgtcaaaaacttgttggcataaaattatatgcaatattttatcataatacttttaatataccctatctaatatcccctacattatttgctttggtgacgcctgtcttctctatttttctcagtaagtctagctaaaggtttatgaacattagtaatctttacaaacaaaatctgttttcatttattttctttttaaaaatctacttgccattgatttctgatttctcttttgatatgtataatatactttctccttattttgtgtgtaatttatttatttttattaatttatttttgagatggagtctcgctctgtcgcccaggctggagtgcagtggcgcgatctccactcactgcaagctccgcctcccgggttcacgccattttcctgcctcagcctcccgagtagctgggactacaggcgcccgccaccacgcctggctaatttttttttttgtatttttagtagagacggggtttccccgtgttagccaggatggtctccatctcctgacctcgtgatccatccgcctcggcctcccagagtgctgggattacaggcgtgagccaccgtgcctggccaatttattcttttttaaaggtttatttgcttttaaccaaacctgaacccttagagtaactgttaatataataatgagtttcttaaagtaattctatggggaaccaataaaattgtgccagagcacacagacatgtggttgtctgacttagaaagtaactctgaacagaaaaataaatatataatgtattttttatgaaatcctcttttgataaatattttacaatcatgaatttgatattttcttgagaagtattgattatagccattttgtttgcattttaaaggtgtacttacatggtttggccatattatgaaataaatgaaggccaaataagcctacctcaatgtgggggtgggcttcagtttgaggggtaggctggaggaacactgaaaaagagagctaactttttttcttctctttttttttttgagatggactttcactcttgttgcccaggccggagtgcaatggtgtgatcttggctcactgcaccctctgcctcctgggttcaagtgattctcctgcctcagcctcctgagtagctgggattacaggcacatgccaccatgcccagctaattttgtatttttagtagagacagggtttctccatgttggtcaggctgacttcaggtgatccgcctgcctcggcctcccaaagtgctgggatcacatgtgtggccattgctccctgccagttttttcttaagaagtagttttgtgtctactccagtgcatagagtaaaagccttagcattttccacaatggagtgtgaatctattaattttagacataatgtcatacctgtttgcaaaagggagctaattcttcaacttagccaaaaagccatgtaagtaagtaatcattaggagttttaactcaatataattttttgacttataatccaagataagcctagctaatataatgagcttgtttttaagtagaggtattaaagatatggcaattaattgttgaggtgtatatatgttaaatgatctgtttcttttgaattatacttctgtgatattcccttttctttttttttttattgtggtcaacccccttttctttcataatagctagctaaatgggaggaagtgtattaaattgactactactccatacccagagtctttacccactcttaatatcaaactagattctaactttaggtataatctacttaacctctttgaatagtaaatgatacctactatataagatttccatgaaattaaataccacctgtgatggttaatattaagtgtcagtatgactggctagagggatgccaagatggctggtgaagcattgtttttgggtatgtcagtgagggcatttccagaggaaattggtgtgtcatacaggaccaatagaaacaagcagatgaaagcgaggggtttctgtctgtttctctttctgtttcctcgtctctccccactcccatttctctctccccattccataaggaaacacctttctcctcctttccttggacatcagactccaggttctttggctcttgaattatgtgacttgaattagcagcctcctggggtctctcgggtgttcagcctcagactgggagatgcactgttgtctttcctgattctaaagctttcagactaggactgatccatgccactggcttctctggttctccaccttgcagatggcctctcatgaaatttccctgactctgtgagttcatttccctaataaaccctctctcttatttcttattggttctctctctctggagaatttggactattacaccatcataaactctctcaatgcagtgcttaatccaataaatacttctatagtaaaaatatattttttatttttatttttaatctgcatgtaattgtctccttatctttttattctctatgagagcatcagttttccagtttatccaatatcataaaatgacaaaacaaaaaagtaaaaatataatcaaacctttcctcactcaactagaaatttctgtttattttttccagagaaatatagaaatatctgaatcttaaagaaccttataaaaccattaggtattagcagatgcaggtgtatattgcactttcacatattaaattattgtcaagtcttctccataaagtcaaaagctaaatggaagtaaacgaaaagagaacttcacacgaagtaatggtgggacacaatggtccatggtggtacacatggactaaatccatatcaaaaatctgagttaccctccacttaaaataattccatatgtttcaaacacaattaaggaaactggaatacatttgagattcaattttgaataactaatgtgtgttaaatttgagcagtataaaagctgccctttgcaaaaacatcctggatccagatatatatttgaaaaaaagaacttaattggctataataatagcagtgatggtcacctattctttaggacagttttttaaaaaactgtttgaggctgaaatatatttgccttctgtgggcaaaacctgatgaccatattaatttaggccccaattttttttttttctgaggaatgtaacaattgactaaactgaaatgaaatactcttatttgaatgcttcccacaatgtctttgtactcagaacaaatatttagaaataggtagtaaataaatgtgtatcaaaagaataaagtctattaacattaaaataagataaaaagaaaattttaaacaaattttgtatcaaaaccacattctttatgtatgttttgtgggggaaaccatatatctgttttcaaagttggctcccaaatttttgtagcttctcaaatacacatcaagttataatgcttagtaggtgtaataatatttgtcaatgacctcagcaggtaaatttttatcattacttggcctccatatttgattaaattcaatcaacatttatttagctcctaccatttgcaaagatctgcctaatgtgatttgaggagaaaactgaagtaagacatgtctctagtctttaggaagcttccatatgcacggtaactagatatccagatttcatttggaaaccagtagactcttgagcatatgtaatgattcctagagcggtgaggtgagaagaggagagcatgtaagataagtatacatgtaaatctaacatattgagccaactgttatgaaaattacaaaattccccatggtgattaaaataagagaaaataagatcaatatgaaaatcattaatggacagcaaagttccattcatacatatatagagaaaagaaataattctcaaggcaattaaaattagaactttccaatttatctgatgcacatgtgacattcacctggtcatttagtgtaattagaaattcacattagtcatattaaattcatggtaaaatacaaagagttcagaatcccaaaccatagtgagatttaaaattatgtttatgtttgagagaataaattgagattagcatacataatttaagttttatgaaatcattctcttagatttaatagatggtgcttttatataaggaaatgaacatggctcatctcgctgtattctttttgcaattccataaaaatattctgacaagtaattttagaatctggaagtcttgtttttggggttagactattgttttctaattaatataattttaaagtttaaatttatttttcagattttacatgtgaaacattaggaaagattaatacattgctaatgacatgaaggtagtatggaaaagtaggcagaatagcaacccaaagtctaaagctatgactccaccattaataaacacttagaatttagtaatgtcacattgtgtttcttagttttaatattcatgtgaaaattacgataataacacatatctcacccagaagaaaaaaaaattgtgaagaaacttagaagttctaaaaatataaggtataatgtaaacatgaataacaataacatttatagcttgatgttttttcaggccttgtaattttcaaaatatgtgtatatagttagctgattagaagaaaatatggttgactcattactgtggaaatagcctgatacagtgaaaaggccatgttttcagttagaagacttagatttgagccctagtccaatcactttttagttttctggtttctgtcacatcattcatccttactgaataccttcagtttccttaggtgtgatctatctgaggctcatagatctgtcccatccacttgaaaatgttgatgtgatgatgatgatgagttcagatgaagcatgttaaagtacttcataagttcctaaacaaatataactttatttttcttatcttgattttctaaacaaattcatttgtgtagtatgttagctctaggcagaaggtgcaggaataagtacagttcagagaagctgtagtggggtagtcaatggcttccaagcctgagtcagaactgtcaatcttaggttcacagctgggtgtgctccagagaaactggaccataggaactgcctgtcatgaagttttataactattccaactattcggtgcaaggtgattgctgccagcacttctctatatgctatgggaaaattacacaccaaagatctgtcatatacaattgctttattccagatactcacaatccagacagagagataataaacacaaaagtactctaataagaataaagagtttaaaaccatttaccaagtttcacaaagaagaaactgttaattgacaaatgacaagttaagaaaataattgcccctctcacaaatactagagatctgagcatatctgtctgcagatgggaagaatcaagtaaggcaaaaaagattcaaaatgcacgaatgaatgcaggtaaggagagggaggataatagagcaaggggttttcagtaggcaaagtggaattagatcaaagcacaagtaaagcagacatggaaaggaggaggggcagaactctgagaacaagggcattaatgagggaatgtttatagaaatgtatattttgaaatggagagaggaagatgagaaaactgatgtctgatgttgattttatgaatcatctgatgaacataatccctaaatttatgaaactacatctgatgaacatcatccctaaattcatgaaactactagttttctaaactaagggttgtgatctgtgagtgggtcatgactcattatggagtcattgaatcattttagtgggttgcaactagtaatgttcaaaaataaaataggctgaaacagacaatattacatcccactgcattttgtaagagcaaatttgttttgtgaaattttgttgcagttaaatttatatgtatgtgtatcctgggtcatgaaataaaaaggatattttctgtggggtgcagttaaaaaatcccaaaaaccactcaactagagaatctctataaactgaacagaaatattgccaaggggcaaataaagcttgtacgtatcatgctggtttagatttgtgttgagtagttaatacaatgtctgccttattccagtggttctcagaaggccagaagcacacattaaggaactagtgatgttgatcaaaggttagaaattagacccagtggagttagggctgttagggaaatgaagatgccctgggtgttgttgaggctaggtcaaggtggcagacctgactttccagactattgcaggaggatcctcaattattaaagcttcagttgttggaaaatatcttttccattgagcttcaagtctaccttcttgtaatatctactcttaatatctatgattttgtcttctggtgccacacaccataaatctaatcacttctctacaacaaggagttttatgtttttaaaaatagctattgtcatttgggttcacttgggtctaaatgtaatgctagttcagggagccctagaggcctggaatcttataagagtgagtacaaaaatttagttgaaactgtaggcatgataagggactggtttgtgcaggacagagtctgtcaaatctgaggatgcccaaactgaatgggacaggtgtgtgggtcagcagagggcacacacatatgcagaactgccaatcaggaaatgagatggcaaccacaacatcatttctgaactcttctccctctctttgaattggcaatatgccttgagagagggcctgataccccagagttcaagtcgctcttaaatcttcattcctgctttttcttcagctttttctcatgggttttcagcccttcatatgtcctcagaacagcacagcccttcaacttttctaaatccagctatttagaataccttaaatgtatatcactggccagtttactgtgcttctgaacatgtaaggaacttatcaattgaatataaaattaagctacttaaaaatatttggataaatcagctgtttttgaatgactgattctgtgtttggtcacatcgatagacccatttatctatgagggttcccatatgtagattagtttatttatatctacagatacattgagtggggaatagaagtttcgcctataattttactcacttttaacaatgtggactttctgtctatattatgtcatttttctttatatatatatataaaatttaatagattgacatttttattacattagttttgaaactttcattgaaaaatctagtgtttcattgaaataactgtattatatatggtctcttataattcaactgagtgtttaatattgggcaaatacattcttatgtcattaatggtatctaacttctcaattaaaataaattctctattcttgtgagttatgtattgcacattaaattaggataaaataataattaattaattgtaaatattttgaataaaatgtcttgatttctagttactactagtatttttaaaagagaagcatgatttatttttcagacaataacttacaaataatcatattcaaattgtcattttataagtaggaaactgagttctacagatatttaataattttcaaagtcattttgctagtcagtagtaacagaacctagcctgtatttctagcttgaataagtactttagcttcctcaaactcttgtgggttaggtctgatactgcaatagaaaggctatgtctatcagattcccttttggttatgtgagctttgcgtgggtttgttcatgtaaatcccatgctgaggtgaaagtttttttttctctctttctcttttttttctgtaaaatgagcgttttgtactgctaacataattcttatatattctaagtgaaaaatcattacatagttgtcaatgtatctcacctctccctaaataacctctactatttatgatttagaaatgaattccctccttacttgacctcttgcttgatttataatcgacatagttcctatattttctgcttatattcttcattttatatttagtgcatctcaattgatttttcttctttaccttgcatttttttccacttttatcttcatcttccttggctctctacactgagtataaatactagaccatagtttcaacccatgggagcagagcataatttcttgctgagtacttaaaattttcctatttcattctattttataattgctttacccactggttttcagaagataggccttcattattccaaagtatgcttggtttattgtttaaaagacacaataggctcaccccactttagtccatttctagccatgctttattctttgtttaacttttaattgctattccaaactctacagtgtctgtagcagatgctggcactgccgtgtctgtattactcaagcctttcaagtgtcctctaactttctcccaactgtcagtacctacatctctgtctctgtgtctgaggcattcgtttttgtttttactgttgttttacttcctaaaaccactgaaggccattctgctcttacgtagaagagatatgaggctggacttaatacaactttactcccccaaatccctaacaaataaccctactgaatataaacattccattccctttataaacaggagaattctgaagcataggttttatcccaagttccagtacttttccatgagatgaagcttcaattattcactccaggtagctgatttcataacaacctttgttggtgcttttttccttctctgaaccactacctctactccctgccagtgtttcctggccccctgaaatacactatttaccctcaaatctttgtttcagagtctgtctcactaatttccttgaagctatagctctctgatttatgaagtagtgacaacacttgagttttggcagaattaaataaatgtgcagaacctgattcataataggtactctaatactattgtacctagttaaaataaatgctgtctttaacctctgagtactttctcccaaatataattttgctccctctatatctcaatagaatgagctattttttactgcatggacagagccatgccagtggtcaccaatgtgataaatctgagggttgcatatgaagagttcacacatttttcttttatgcctgcaactccattgctagtcacacattttcacgcagtgagaatagtctttttttttttttctgcagtcctattttaatcactacaaacactacagggtaatgttcaatgaatggttattggaagagtctacctttttcttttttttttttttctcttaaaggaacaatatgctatgatctttcacactttccaccaacttctcttctccaggcttttcctacttatcctgtaaaacttaatttacaggtcttctacaaagcttgacctcatcctccaaagcttttagttacttttactctaagttgccatagcttttaatatttatttcaatcaaagtgcataatctcctgaactgttaacttatttatctcattagcaagatccttaattgatgaggctgggttatttattattgcaactcaacacctagaacaatgtttatgcatactgacactcaactgttagatgaatggattaaatttataaatactgttggaaagaagtaagctattgttaggccttaaagtggctttaattgaatctaaattttaattgaataaattggtacatctcaattgattttgcttttttaccttgcttttttcccctatatattaaaattacttttaattgcaaaaattgtaattacttttgtaccaacctaataaatagttatggaatatgtattattccactgcctcaaatagacacagctgactatttctcatttaccacccctacttttatgttatcatgtaattaaccatattctcctgtttctaatgtgtggacaacatttaacttgctaatggttgatctgtgaatattttttactttagacacaaagaagcctttaggtcatattatacattgaaaaaaaaagataacttaaaataatacagtattaggatttgactcaatttctgcttaagtaaaagcaaagaaactagatatcaaaatgcatactttttccaaagcatatgtaatataaaattacatttatttcattttgttatatttgtcataatttatcacctaatttataatgtattgatcttctaaatgttggaatacaaagcatattagtttaataaaaggttgaataatgtgttttacttaccaattaaatcactatatagtatagcagtgctgtaggaggaaaactagtcttccaaaaatcaaaattttcatatatgttggaagagttggctatcacaatgttacataggagtagattcttgttttctttttaatggatgctgacaagaatgcctgagaatcctatctgctggcattggaagattttacaaaatacaatctgatagtattttccctacttaacattaatcttcttatataatcacttggtcttctataaaattatttgttaattaaaagaagtcctatcattactcttgatactgcaaaaaaatggcctttatgagtaaacataaatatgtaactaaaacataaatgaaatcaggcagttacaaataagaaaattagtcatttggggcaagctgaagagttaagaaaacacgaggatataatttactggcacttcagataaaatagaaagaaataatggggcttctctctaggtatacatattataaaattatagtattttggcatatttgtagtgttgctatttttatcagaccagaatgcaccattctcagctgtatttgagttgagaagaaccaaatagtttttaatattgagtgttcaaaatattgcatgggatatacttatactcaaaaataatcattattcatctgaaattcatatgtgactgggcctcctttatctggtaaccctacctagtaggaaagaatgttgtgtacatttttaaaatactgattaacctagtaatatgattatttaaggaaacataaacaaaggactatttctgaaatattttccagcgaagtttggaaagcagtcttatctattgtgttaagataaagaagggggaaagtcatattttgttttgttttgtttttttttattaacttcaatttcttatcacttttgaacatacaatatgtatttacttaggagtcaaaagttcatgtggtaaataaacactataaatgtaaaccaaggatcaatgcttcaaaagcaaatttattcagtataaaatgtcagagcagcttttatatttccaaatacataagatgtaaattggaaagtgtttgcattttaactagctttaacacatccattatataataacatgagaggaaaaaggattacagcttctattttactacccctttaaaattccttcattttcatttttgtataatgtggtttagaggagaaaaatcagaactgacaatattatttaatgaaacttttaattatgtagataatgtaaatctaacaccaagtctgcacatttataatgctgttttcaacattgtaaaattgtggtattcaacagttgggaaatctggagtaatgtttgtttatctctcagaatttgctatacagcttatgacaaagaattcaatgtgaaccacttctgaattatgatgattatatatagatgaaatgtttcaaaacttactacatgtgaagcactttgcctcatgctttgcaaacattgtatactttaatattacgagttttaaaatattagtatatttgaaaaatcacataaacacttccttttcagatatgttttgctagataaccctctaaagataacactgaataaagtaaaaatccattgctgaaattgcacaaaaataaaaggtatgcaaaatcgaaaataataaaaaagctgtaactctgagtgaaaagtgaggattgaagatggctatcacttaaagaattttgtattatcctagaaaacttcatcttttaaaaaacagcttcatagcacctggagacaaaagataaatactggggaatgcccaagctatagagtctaagaagataaaccccggacataaggtttacatcctcagcttcaaaggagatggtgcaaaactaaggtgtgacaaagtatggatcaaaacattacaaagaaccttgtccatcatccatagtgctaagggaatgtgaaaaaacaatcaatctgagaattaagttctcagcagagttttagtataattcacaatctttatgatgtgaacaatctcaaatttacttattttaaaattgtgtcaggcaacttacactggcaagaggcaaatgtttcctagaggaatgacaaattaaactatgacatcacataatactcaagttaaagttctaagaaaaataaaaatctcatggacaaaattcacaaagtgcaacaggaataaggtgtgattaataagagattaatacaaacatcaaaatcgtacccacaaagatgttaacatactgaaaatattacaaccaaaattacaaacataactatgactaggagattttaataaatgagaagcttgaaaatacaagcaagtaaataaaaactcagaaatatttagaaaacaaaaaataaacttctaggattgaaaaatataaattaaaatgagaaagaaacatcaatgaataataagctgtggcctaaaaaatagacttgaagaaatttcacagaatttctcacagagactttggttggaaaaatatgaaaaaggaataatagacatactgctcttaactagctaagggaaaataataaaatgtaaaaattatagccgtttaaatagcagaagagtttcaagtggccagtatttgaacacaatgaaattaaatcagaaaccaataagttttaagtaggaaattttacatacttggaaattgtaagaattacacctaaaatttcatgaatcaaagaaaatatcaaaaataatgatggaaattaagatattttatttttccaagatggtggattagaggcttttagcatgcttcagctgctttgaaataggaacagtgcataaatattaactctgtgaggtttgattcaagaaagacaatgggaatccaccagaataatgaaggacaccctaaatcctgggaaggagaacatgagcaaaaagcccctgtgacagcatccagctgttaaaagtgagtgaaaccctagcacacgagaaaggcagacagcctccttctgtgactcaactttccactgaggatctaagtaacccagggagagggagagccctttgtttcactcaagccatggagctaacttggggagaggcttggaggtgctgtgaggaataaacactgggaaaagctgcagacattttcccagacctgagaccgagagcaggatgtcattataacctgggtgcacacaaagtcagccattttgtggtgactccgcaatgtggccacttgggcattttagtcttggggcagagatagaagtacctgctgtggaccagggtacagacctccacaactagaacaatagaaagtgtctcagcagcaggtgctggaattgtgctccccactgtgggacaagaggagatatatgacagctgcagtttctcctgaacaataagacttgcagccaggagcagtttgtcaacctggaactgtcatttttcagtgccccagctgctaccctgagatcatggtgcagcaggcctctttcttttccatcacaaggcagaagtctaggcatttggaacacctgcttgcctggaccagcagcttaagcctcctcacacttcatggacatagactgtggtgcagcagggccctctcagatttccaggcatttgaagcagctactcatctggattagcagcctgacctgccccacatttcctgtgcagagatcctggtgtaaggagctcctctgtgttttatacccagtgagatctccaggcatttgagcacctgctcacttggttcagcagcctgagccatttcattcttcctggcaatagatcatgatgcagtagggtcctctctgctgcccacccaggcagatctccagacattctgagcaaccactcacctggataagcagcctgaactgtcccaccctttatgggcatagattgtggtgcaataggaccctctctactccatacttaggcatatctccagatattaaaagcatatacttgagcagattggcaacctgagctgccccacccttcctgtgcagagatctgtatgcatgggtgccatctctgcttcatgtccaggcaaatctccaggaattcagaccacctgcttgcctggttcagcagcctgagttgccccaccattcctgtgaggagatcttggtgcagggggctcctctccactacatgcctgcacagatctccagacatctggagcacccactctcctggattaggagtttaggcttccctcctacctgtgcagagaactcagggctgaggagatttcctagttccacacacctaggcacacctctgggcacttggtggctgcccagtggattctcctttgacactgatgtctgtgcctgacatcaggagaacagaaactggacctgcctggtctagccttgtttatcagggcccccacccctccagggatgagtagggtgttcaggccattgtgcactccacaaatcaggccattgcctgaggcaacagagggcttctgccattaaacaaggatcaggtgtataccgagctgtgttggtcgcagctagctcttaactataagcaccatctactggctggtaggtccaaccacagagcccaatattcaactgctgacagaagcgcataaggctatagaagtaaaaccaaaacaacctacccaacattgtctacaatcacataaccagggatgggtaaagggaaagggaaataaaaaaataataataatattacagagaaataaagaaaaagaaaaaaaatctacccacaggaatataattacaaaaattagaagtcctagtctccagatgacaaggaaccagtgcaaaaattaaggcaccatgaaatatctgaatgtagcaacaccaaaggatcacaatagctcttcagccacatccctaaccaaaatgaaaactcagaaatgacacaaggaattcaaagcatggattacaaggaagctcaacaagatccaagacaaggttgaaaagcaacacaaaggaatttctaatgcaattcaggaaaggaaagaagagataagcatattaaagaaaaattaatcagatcttctggaattgaaaaactcacttaaaggaatttcaaaatacaatggaaagctttatcaatagactgaaccaagccaaagtaagaatttcagagcttgcagactggtcttttggagtaagccagttaaaccaaaataaagaaaaaaaaagttttaaaaacaatgaacaaagtcttcaagaaatatgggatgatgtaaagcaaccaaatctatgaattcctggcattcctgaaagagatagagaaaagatgaacaacctagaaaacatacataagggaatacttcaagagaatttttcctaatcttgctacacagtagacagcaagatacaagaaatccagagaacatctgtgagatactatacaaaacgaacaacaccaaggcatgtagtcaccagtctgttcacggtgaatgctaaagaaaaaatcttaaaagtagttagagaaaaaggtcaaattatgtacaaagggaacactatcaggctaacagtgagagttctcagcagaagccttacaaaccaggagagtttggaggcctattttcagcattctttgaaaaaaaaagaaaaaagaaagaaagaaggaattaatgaaattccagccaagaatttcatatcctcccaaactaagcttcttaagcaaaggagaaataaaatctttttcagaaaagcaagaagtaaggcaatttataatcactagattattcttacaagtaatacataagggagttctaaatagagaaacaaaagtacaatacctgctaccacaaaaatacacttaagtacctagcccacagcccctataaagcaaacacacaattgaaactacaaagcaaccaactaaaaactcacgacaggatcaacctcacgtatcaatattaatcttgaatgtaggctaaatgccccccttgaaagtcatagagtggtaagctgaatttaaaaaaagcacacagaagatccatgtatctgctctcttcaagacaaccacctcacagtagcagcacctatactgtcaaagtaaaggattggaaaaagaagcatcataagaacagaacacacaaaaaaaggcagggtagctattcttatatgaaacaaatcagattttaaaccaataacagtaaaaaaaaaaaaaaaaggacaaagaagggcattacataataaagtgtttgacacaacaagaagacttaactatcctaaatatatactcacctaacattggaacacccagattcataaaacaagtacttctagacctatggaaagatgtagatagccacacaataacagtgggggacttgaacactccgctgacagcattaggcaaggaactaacaaattctcagtttaaatttaacaattggccagttggacctaatatatatgtacagaacactctacacatcaaccacagaatatacattattctcacctgcacatagatcatacaccaaggttgaccacatgttcagccatatagcagttttaacaaattgttcaaaaaatcaaaatcataccaaacatactcttgaaccaaaggggaataaaaacagaaatcaataacaggaagatctctcaaaactacaaaattacatggaaattaaacaccttgctactcaatgacttttgggtaaataacaaaactaaggcagaaattaaaaaaaattatttgaaataaatgaaaacacagatacaatatactaaaaatctctgggatgcagcaaaagcagtattaagagggaaatttacagtgctaaatgcctaccacaaaaaagttagaaatacctcaaattaacaatcaaacatcgcacctacaggaaataaaaaacaagaacaaactaactcctaaggtagctgaagaaaaaaaataactaaaatcacaccagaagtgaatgaaattgagaccccaaaatctacccaaataatttatgaaaccaaaagttgggtctctgaagaataagtaggattgatagactgctaactagactaacataggtaggccagctgtggtggttcacaccagtaatcccagcactttgggaggccgaggctggtgaatcacaagttgaggagttcaagaccagccaggccaagatggtgaaaccctatctctactgaaaatacaaaaaaattagccaggtgtgttggcgggtgcctgtaatcccagctactcaggaggctgagggagagaactgcttgaacccaggaggcagaggttgcattgagctgagatcacgccactgcactccagcctgggtgacagagcaagattttgtttcattaaaaaaaaatataggtaaaaagagagaagatccaaataagcacaatcggaaatgacaaacgtgatgttacaattgattccacagataccaaagaccctcagatattgttatgaacactcccatacacacaaattaggaaatctagagaaaatgaataaattcttggaatcacacaatctccctagattgaatcaggaagaaattgaaacccttaacaaaccaatatcatgttctgaaatggaatcagaaataaaaagaaaaaatctaccaactaaaaaaagccctggatcagatggattcacagcagaattctaccagacatacaaataagagctggtactaatcttcctgaaactattccagaaaatcaaggaggagggactcctccctaactcattctacaaaaccagcatcccccgataccaaaacttggcaaagacacagcaagaaaacaaaactacagaccaatatccctgatgaacacagacacaaaaatttctcaacaaaatactagcacagtgaatccagcagcacatcaaaatgttaattcagcatgatcaaataggcttcattcctaagattcactgctggttcaacatatgcaaatcaataaatgtgattcaccacataaacagaatgaaaaacaaaaaatatgatcatctcaatagacgtgagaaaaagcttttgacaaaatctaacatgtcttcatgttaaaaacattcaaggaactaggcatcaaaagattgtacctcaaaataataagagccatctatgacaaacccatagccaacatcatagtgaatgggcaaaaactagaggcattcccccttgagaactggaacaaggcaagaatgcccactctcaccactcttattcaacatagtactggaagtccttcccagaataatcaggcaagataaagaaataaaaggcatccaaagaagtaaagaagaagtcaaaccatctctttttgctgataatatgattctatagctacaaaactctaaagactctacaaaaaggttcttggaacacataaatgacagcagcaaagtttcaggatacaaaatgaatgtacataaattaacagcacttctatacaccaataatattcaaggtgagacccaaatcaaaaacacaatttcatttacaatagccacaaaacaaaaaacaaattaaaaaacaactaggaatacatctaaccaaggaagtgaaagaaacaagacatctacaaaatactgctgaaagaaagcataggtaatacaaacaaatagaaaatcattccatgctcatagactggaagtaccaatatcattaaaaatccatactgcccaaagcaatgtacagattcaatgctatttctatcaagctaccaatgttatttttcacagagctagaaaaaaactattctaaaattcatatggaaccataaaaagccaaaatagctcttcaaaccataccataaggctacagtaaccaaaacggtatggtattggttactgtactttctattacaaaaatagaaagaccaatggaacacaatggagaacccagaaatgaagctgcacacctataaccatctgatctttgacaaggtcaacaaaaacaagcaatggggaaaggactctctagtcaataaatggtggtgggatacgtggccagccatatgtagaggaatgaaactggacccctaccttttaccatacaaaaattaagtcaagatgtattaaagatttaaatgtaagacctcaaactataaaaatcctagaagagaacctaagaaatggcattctggatgccggccttcagaaataatctatgactaagtcctaaaatcaattgcaacaaaaacaacatttgacaaatgggatctatttaactcaagagcttctgcacagcaaaagaacctatcaataagagtacacagacaacatacagaatgagagaaagtattcgcaaactgtgcatccaacaaaggtctaatgtcgagaatctataaaaaacttaaataactgaaaaaacataaacaaataacccccttaaaaagtgtgcaaaagacatgaacagacaattcccaaaagaagatttataagcagccagcaaacatatgaaaaaatatcaaaaccacaatgagataccatctcacatcagtcagaatggctattattaaaagtaaaaagcaaacaaacagaaaacagtagatgcttgagaggctgtggaaaaaagggaatgcatatacagtgttggaacataaattagttcaactacagtggaaagaagtttggacatttccctagaacttaaaacaggactaccatttgatccagcaatcccattagtgggtggatgtcccaaagaaaagaaatcattctaccaaatagacacatgcacccatttgttcatcacagcactattcacaatagagaagacatggaatcaatctagatgttcatcaatggtggattgggtaaagacaatgtagtacatatacaccatagaatactatgcagccatataaaagaatgaaatcttgttctttgcagcaacatgaatgcagctggagaccattatcctaaacgaattagcacagaagcagaaaatcagatgcctcgtgtttgcacttacaattgggagctaaatactagttacacatggacataaagatggcaaccatagacactggaaatactggggaaggagggggacaatttttcaaaaactattggttactatgctcagtaactgggtgacgggaatctatcgatcccaaacctcatgtgtcagatattcccaggtaacaaacctgcatgtgtacccactatatctaagatgaaagttgacattattaaaaagaaaaagttaacataaataaggacagaaaaaaatctataattaaataaatatgaaaatgctgcttttcaaaacttctgggatatagctaaggtaatacttataggtattctagttttaagagcttgctttagaacagaaataatgctaaaagttaaagctaagtatccaacttaaaatttaagtatttttataaacaagagagtaatttaagcataaaaaactaaaatgtaaaaactaataaaaattgaaacagaagatcaatggagtcaaaagaaggcaatttttataaactaaaaacatgccttgttaaattaataaagaggcatcagccaaaagtacattaatatgaaagacaatataggtataagtagagatgctattgatgttatgcagctaataaaagagtattaggaaaaactttattcatgtaaacatatatatgaaatgaatacattctcataaaaattgatttcaccgaaactgattccagaagaaatagtaaaccttaatggttcagtcagaatcaaaataactgaaatttcttttaaaatcctctcattgtgtaaacaccagttccagatggtttcaaggtaagattttcaggtaattctaatattacacaaaattctgcagaccattttaaaaagaaagacgacagaaacagaagattataaaaaataaaaaatgtatattacaggcccacctagtcattaacagatacaaaaatagtaaatacgttatttgcatctcaatccatcaatttaaaaaataaaaatatataggtataatctaagctgaatttctccaaagaatgcaaaccccgtttatactagaaaatggatgaatgtagttcacctcattattcctactttagatggaggggaaaaattaatattcaatatccattcagaatgaaaaccttaggaaactaaaaaagaagggaactcccctagcatagtaaatgatttctactaaaatacaatgaatatgttattaatggcacatgttgaaaccttcttttaaaattgtgaacaagaaacaagtcagtggaaagtttctgttatcacaatttctatttaacattgcattgacggttctagctagtgcggtgagataggattaaaatgtttaataatcagaaaggaagaaacaatgctgtcactatatctacaaaacataaacttactgattattagaattaataatttagtcatgttactagataaatattaatattcagaagaaaaccgcatttttagataacagtaaaaatcacttgcagaatataattgtattaaaagaaaattacaataacatcaaaaatatgaaatgcctaataattaaactaccataagatgagtaaatcctttaggaagaagactacatacaattttatggaaggatattaaagaatacctaaattaaaaaaaaaacccacaacacattcttagaaaatttcagtaatataaatgcatggatagtcccttaacttaaaatactccttcaaataaaaatcccaccaggatttcctgtggaatgtggaaaatttactccatataaaggatgaaaacagccaggacactatttatttttatttttatttttattattttttttttttgagtcagaatctcactctggggcccaggctggagtgtggtggcacaatcttggctcattgcagcctccgcctcccaggttcaagcaattctcctgcctcagcgtccccagtagctgggattacaggcgcccgccaccacacccaactaatttttgtatttttagtagagacggggtttcaccatgttggccaagctggttgggaactcctgaccccaggcaatccacccaccttggcctcccaaagtgctgggattacaggcatgagccaccacgctcagccaggactgttaaagaagaaaaataaagaggggactttttgtttgaagtattgtaatatattaatctgttctcacactgctatgaagaaataactgagactggctactttataaaggagacagatttaattgactcacagttccacattgctgggaggcctcaggaaacttacagtcatggaggaaggaagaggagaagtaggcgccttcttcacaggggtggcagaacagagtgagtgcaagcaggggaaatgccagacgcttacaaaaccctcagatttcataagactcactcgctattatgagaacagcacgggagaaactgcccccgtgatccagtcacctcccctggtcctgcccttgacacatggggattatggggattacaattcgaggtgagattttgttgggcacacacagcaaaaccatattatagtgattaaaacagaacagtggtgaggaagagatagacaagtaaaaaaatgggacaaaatagcagccttgaaactattccattcatggatgcaaattggatttacagcccagtgggcgttgctggttagtgtgggaaaagagagcccatttcattaataatactggaaaacatagtcatctatttgaacaataaaataaaattggactcctacatcatactgtacacaaataaatatcatgtagattaaagacttatctgcaagagtataggaaaatatctttataattgtagtggaggaaataattttttaataaaatcataaaaagcagatagcctaaggaaaacgataatttaaatgatacaaaaaaaccaaaaactttacagagagggaaatataagtaataatctgtaaaaaagtgtttctaatatttacaactgtcagagaactagtattcagaccataaatcagtaaaaaaagattcataaaagtgagtaaaagataaaaataggcattttgcagagggggtaatataaattgctcataatttttttaatgcttaagcttaatactaattagcaaactgcaaattaaaaccaaaacccaattccaaaacataatgacctgattgcaaaaagtattaaaagcacattagtatttgttcaatactagtgtgctgggatgattttaatgataagaaacactttatttttcttaaaataatttagcatgggtctgctttgtgaccaagcaaattcataatcatgtacgtagactatagtaacactttcacatttgtaccaagagacttttacaatattctattcttatcaaaactgtttataatagtaaaaaattggaaaccactcaaataagccattaaaagggtctggctgctgggcacagtggctcaagcctgtaatcccagcactttggaaggctgaggcgaaaggattgcttaagcccaggaattgaagaccagcctgggaaaaatagcaaggtgctaaatatatatatgcaagctgggcatgctggtatgtgcctgtggtcccagctacatgggagactggggtagaaggattgcttcagcccagaagattgaggctgcagtgagctgtgtttgggccgctgtatgccagcctaggcaacagagcaagactgtcaaaaaaaaaaaaaagtggactagttatacattcaaatactgtaaagcacttaaaataaacattctatcactatcacatccaaatagatgaagcttaaaaacataatactcagcaaacaagccaactcaaggatgcataggatattatttcatttgcataaatatccaaaacatatgaaacaacacatctaggcttgctcataggtggaaaaattacatgaaagttaagtgagtgttttccatactcttcagaattataatttcctctggaggaggaggatggtgcagctggctacaacagaggcctttatggcactagcagctggtgacattcactttcataacatctggtggcgattattcaggtgtgtttacaattattctctaaactacatatgtttaatacttttcatttatgatagatataagaattaaaacttttttaaaaaagagaacatgtatatgaaacttaaaatgccattgtgagccaggtgattgagttagacaagttactgctgctcctagtgtgttactaccctgtaaaatggctcattaaagaacaaattttgggattttttttctcatcatctgtgctgagtttaattaaaaacacacttattatactgaactataggatggagtttctcctgtagctggagaagtgtccctcagttttgtagtgactaaatactggagtcaatttctgaaggaaattagagattatccttccacgaattttttaaaatatgctttgaatatagcatattatatgtaaagttctgcatggttgttccttcataaaatactatattttataatgcactagaaagaatactgtgatagaaatcacaaaatttcagttcttgttttgcttttatttcttataagcttaatctctgagtcctaatttaatgcattatctatccaatgcccagatcatgttgtattacataatgtttacatgaaattatgctaatagtaatgtcctttacatataaaaggagtcactactctttgtatttaatcactcttttaaatgaataattggcatatatttataattgtatatatatatttttaacttttattttaggttaagggatacatgtgcaggtttgttatagaagtaaattgcatgttgtagggctttggtttgcagattatttcactactcaggtaatgagcatagtacctaataggtagttgttttattctcaccttcctccaactctccatcaagttggctctggtttctgttattcccttcttgtgttcctatgtactctatgtttagctcccacttatatgtgagaacatgtgacatttggttttctgttcctgtaatcactcttttttttccagtgagaagttttacatgttttcaggtgcattatacagatattgatatctcataaagtcaccccatccaaatttgccaaccttgtataatatgtcatcaaaatatgattggcccttcatattcattggttccacatctgtggattcaacaaactgaagactgaacatatttggaaaaaaatacaataaaaataatgcaacaataaaaataatataaataaaatatagtataacaactatttatataaactttacattttattaggtattataaatatctggagatgatttaaagtatactagaggatgtgtataggctatctgaaaatactacaccaatttaagtaaggaacttgagcatctgcagattttggtaaccatagggatcctggaactaatcctctgaagataccaggagcaactgtgtatatttttcacccccttaattgctcagaatcctgctctgctagtctaatgaataatgaaaatttaactgtgtcagtgtggctatgtgtaataatagcatggcagcttaattttggttacatagttgaattataacaaaataatttaggaaaagccatatagttgaataaatggttattccataagctgcaatgctctgtaattgtagaatcaaaaacaggtgaagatggtagcaatagatatacaatttacccttgaacaaatgggggttagggaaaccaacctctcttccagtcagacatccatgtataacttttaactcctcaaaaacttagccattaaaagtctactgttgaccacaagccttaacaataacataaacagttaacacatattttgtaaatgtattatgtactgtattcttacaataaagtaagctagagagacaatattttattaaaatcataggaaagaaaaaatatattgactattaagtcaaattggatcattataaaggttttcatcttcctcatcttcacattgagtaggctgagaaggaaataggatgaaatagtgaaggaggtggaagaggaggcaggagaggcaaacatactcactgtaattttacaaaaatacatcataatttctgtctgattttttttttgctttttcatttctaaaaaaatgtttctacagttaccaatcctttctccaaaatttgcccatatcatagaagggttcatgtcataagataagtcaaaagtagtcttaaataatcagaacccttctaccagattgtctaacgtcagttttgttttctggcactgcttatttgatgtcttcttcctcatcatctagctgtggttcagaagccttaatttccctcatcatcttttgttaattcctttagtgtggtgtctattggctctactttttctaagatccatatcttgtaaccttgcaccccaactgttttattgttgtggttgatttagttttgtttttggtttttgccacatccacaatctcttttatgatttccttgattggctctgttgtaaatcctgtgatgtcacgcataatacctgggtacagttttctccagcagtaatttattgtttcagacttgatgactttcacagctttttctataacaatgatggcatcttcaatggtataatccttccagactttcatgatgtattctctatcagggttctcttctattgcattgacaagactttccatagaatgccatgtgtaatgagccttaagcgtcctaatgaccccctgatttagcaagtagactaagtcattgccttcaatgttgagctcatgaagttctgggtgctaggggcattgtccaatagcaaaagaatgttagaaaggcagtcctgtattggatcccagcactttgggaggtcgaggcaggcagatcacctgaagtcaggaattcaagaccatggtcaacatggtgaaaccctgtctctaataaaaatacaaaaattagccaggcatggtggcagatgcctgtaatcccagctactcgggagcctgagacaggagaattgcttgaatgcaacccaggaggtggagattgtagtgacctgagatcacaccactgcattccaacctgggcgacaaagcgaaactccgtcaaaaaaataaaaagagagagagagagggagagagggagagagggagagaaagaaagaaaggaaggaaaggaagaaaagcaagaaaggcagccccttactggggcttgtgtcttcatggacaaagcatcagtgaaattaatccagaattctcattgtccaggctttcttgtggtacaacgaagactgccagctggtgcttatttttttcctttcatcgttctggggttagcagctttataggtaagggcagtcctaataataaacccaagtgcatttacagtaaacagtaaagttagcctatcccttcttgtcttaaatactaatgctcacttctcttccttactaataaatgtcctttgtggcacttttttttttgaataaggtacttttttccttgttaaaaacctatttaggtagatatactttcccctcaatgattttcttaatgggatctgggaattttgctgctgcttggtctgcaaaagttgtttcccctgctgtcttgacattttgtaaagcctaaagctatttctataatcatcaaaccatcctttgctttatatccttcactgtccttttgatttaagttttcacataatgacttcattttttctcaaatcacattagaatttataggcatgcttttcttataccaatcctgaagccacataaaagctatgttttcagtaaacggtaaaacaagtatttcacaaaaacagtaagattttgtgtctgttggtataactgcaatgacaacttcatgaatttcttattctgtctttaccatggttcttatgttggattcatttatcttgtaaaagtaggcagctacagctgtatcgtatcaagcaattcaactttttcttgcaatgtcatgagttttctctgcttcttgggaacacttccagcatcactagtggcacttcatatgggttcgatgttgttcttcaaggtttatggcatttgcactaagcacaataaaaatatgagaaaaccatgatagtttaccttttactgctatatgcaatttactgtagacaggaactgctcaattgaaatgagtactgttacaagggcattttaagcagataaaacacttcagctcaaggcaatagcaacaggaggtgactataaaattattacagcaatagagtaagtactatagttaattttatgcagttatgctttactattgcatctgtatcttcatttgcatttctctgaactgtaatagagccatgaataatccatttgtatgtataagttttgataaattttaactttttgtaatagacttgtgatatttttagtggtaaatgataaagcagactagtatatacatgtattttgtgcaacatgacatacctttttcttaatttttgatattttttgacctatattttatatatatttgtcttcaagttttttcaaattgtccaaagtctccccaaatgtttcttatatagttattgaaaaaatactgtgcataagtgacctgtgcagtccaaatctgtgttgttcaagggtcaatagtacacatacagtcatgcatctttttaaagacatgcatatgttctgagaaatgtgttgttaggcagtttcatcattgtgggaacaccaaaaactgcacttaaaaaacctagatggtatagcctactacacacctaatctatatggtatagcctgttatccctaggctaaaaacctgtaccacatgtcattgcactgaatattgcaggcaattgtaacacaatggtaagtatttgtgtatctaaacatatctaaatgttgattatctaaacatagagaaggtatagtaaagtacagtattatgggaccattgttgtacatgcagtgtgcatcaactgaaacattgttatgcagtgcctgactttattttccatgaggtgtgttattatatagcttagtcatttgaatccgcttttcatcagaatccttctcactttctgggtttattataatgcttgtatttgtttttatgttgattaattagaaatatttttggaaagtacaactctagaacttacgtactctaccttaatgaactctaattttaaagagggagctttagaaagtcttttaaggaaatgaaaataccttgtgaacttccaaaacactcatatttccccctttttcaacttcgttgattgacctggaacccttaaaggagaaaaagaatctatcaagtagagctggatcaagtgtaattttggtttgttttattttttaatagttttttctctcagggaagtttcatgtctttcgtcagtcatgggagtttctctactatcatttattcaatttcaattatgcctctggcccatgctcattattttcttgctctggcagtttagcataatggttaagagcatgccctcttgagcctcaggtccaattcctggcttctctatttattagctatatgaccatgggtaagttaattactttctcttcctcaaaggcttgctgcgatgagtaagtaaatgaatatatgtaaagtgctcagacagtgctcagtatattttaagtattatgtaagtgcttgctcttattataatgattacttttatatagaggtgtaaatctttttatctttttttccattcctctttcatactttctgtctgtataacatttggaattgcattatgagctactaggcttggtgctccagaatatttgtgtgcccaatagctgtgtccacctttcttttttagtctatataattagagtttgcttagttttttgttacaatctcaatcattatacttttatatttcaaaaatctctaataatttcttattgtacaattgcttagtcttatataggtataatatcttcctaatctctctccagatatttggacatattttggacattttacgaaacacactttttgctaactctttcaacacctgtaagtgtctctgtcatggttctgatatttgctgctttcttgtgcactttgtagcttagttgtcctgtacgactatctcctcttttcattcagggagatgggtgtgagctgaaatgtggcttggatacttcgttagtgactgtgagaaagtggcatcccttggcagctgtttttctgagtatgggcacttgcaaccaaatgttgtgagccattcgggacacattatgcctccgtcttcctgacctccttcagttaatattcctacctcgggacttttccattgttgtttgccaaggttaacttacctgactactccagctgtgagaccatgctaataattctggtcgttgatccttagcatcttattcactggttccacgccctaccagcacagaccagttaatgttttattttaaagttgtgctttgatatggcttttttccgctgcttgttgtttctcaggattctctagactctgtagcgcatctagagtgactttttgtttttagtggagctatgacttatttttatatatgacaaaataatgtctatgaatttgatgcagaaggagaaaattgcctaatgtattcaagtctgctatgttgaaatagaattcaatagtgaccttcaaaaagatatgttctaaccacacgaacctgtgaatgtgaccttttttttttttaaggtgacttatgcaggtgtcattaagtttagaatctggaaatcaggtcatcctcgattatctgggtggaccctaaagttagtgataaatgtcctcacctgaaacacacagggagaaggaacagaagatcatgtaaagatagaggcaaagatgggagttatgtggtcacaagccaaggaactccattaaccactggagctggaagaggcagggagggattcaactttaagattttagaggaagtgtagccctgctgacattttgattttggacttctggctgccgggctatgaaataataaatttctcttgtttcaattaaccaagtttgtggtaatttttaatggaagtcctaggaaattaataaaggtatcttcttctattaatacacaattttagcagaaaatattgtctctcatttcacagaaaatattaagacagtacataaaaccttccttaatttcctccttgtcacttacaaacatgtttatatccacaaccatacctaccttccacatcccacctactgttcaaagttacatttgtgttagggaacctctgccatttctgcctctgctttaccaacaaacgtctttgtaatctggtagacattttccttttacatgtgaacagagccaagcctctttgaaataaaaaatcctgcaggtttaacaaatcacccttcaacttctgctctggattctgtcttcattttacagccaatcgttgagggagagcagccagcacacaccgtcctgtctgtatcacatatctcaaactaatacagtctttctcttgaggctaatatgccactgaaagctaacagtaccaaggtccttcacattgccaaagcctgtacacatttcctttgcttatatcaattgccctcactttgatatttgactccggccattgcacaccacccttcaatctctgtttaccctcttcttctgtttcttctgattgactgtttcttcccaatctcacacataggtttctttctctccccagtgcctgttaaatatcaggagtataatccaaggttctgcctttgtccctcacttcttgctacattgtgtgatctcaaggtgaccacattcatactcatgattttatctttatttgatatactggagactctcaaatatattctcataatttagaactcactttgggcttcaatattgaacatccaactctcactggcacatctccattaggatgtcccaaggacactttaatctttatttttgacatcttctcatcctgacttcagacttgttactctgtattaccttttttagtcaacagattcttcattcaaacaactgaaacagaatattgttattatctagaagtcctttttgtgttctcttatatcatatctttgtatgtgatttaagcaatcattttattctgctgtatatcatgtaaaattggatctagaatgataaatagtttttatctcaatcaccatgtgccattgatttgtaggggctgccaagagtacaaagttgagaaagatagtgtgatcacctctagagtgagaggaaagacttccacaattgatgatagatgaaatggcaagggtgaagaaaagtgaagcatctagctctgaatgtgttatccatgatcttagattataaagttcacaggttaagtcagtgtgtgtgtgtgtgtgtgtgtgtgtgtgcgcgtgcgcgcgcgcacacatgcacgtgcacaggcacacacttgatttgggatattttagtaaataaacagataagcacaaaaaggatgctttaggcaggaagaacaaagtcagagaggagtcaagtggaacttaggggatactaatagaactccataatttaatttgcatagagggaagtttgtagttgatgagagaaatttagattggactcaaattagttaaagccatttgtgccaagttaaataatctttatctaagataatacagaaggatagtaaaatctcattctttctggcattgtggaactttacaaattccatttaaatttatttttaaacacttcccttacagggtaatctcaaaataaaatgacgcagtttaaaacaataacaattattcaaaaaaatagaaacatgttgtgaaaatacagattatttctctattttaattaagaatggtagtaacagcagtaatatatcttctgcctgcagtgtcacccaccatctgtgtgtttcttgacccctggcaatagtcccaggcatggatagaaatcatccctgcagtgggtgcagccacattaattttcactagggcttcatagtaagtttccatattgcagttcttttagggagagacctctggtcactcgacttcatggcagacagctcagctaattgaagaagtgatagtattctctacaaccatgagtacaattaatgaaagtattctgctattgcctaggcttagattttttttcttcacataatttatcagagaatttgaggtttgcaaatagatttttaagatgtcatttgggactttcactgacctccagaacagggccatttccattcttcttctgagcagcttgcctatttgactttaacaagccaccagaacagctgccctaacacccctgctgttgctatttctgatattactagtctagcaccaaggtttacttattttttctcttttctcatcatcagccagctatgaaaaaagaaccattcttcatgataaaggtcatatttgcatttcaaaattttgagtgactgtactgcctgatattaatatatattataaataatatggactcaaatttccaagtagcagcattgactataaataaatatatctaggtaggaactataggaggctcacctatcaatgattgtttccagttttaaagatatacttttaataaactataatatgatttcctgtaagatacagtttttcatataaaaaccaaagtggcaagtacagttcaagtaattccaaagttcctcttgcatgaatagccttctcacatatgttatcctaacattgatctttcatttaacttcaaagtatgctctatttccctctgtgaaatcggactttgtacttcattggtcattttatccacatatgctttctctttatgtttctttatttggttccaaaaatattggcattgtaataagtagagattttatcaggtatatcataaaaataattatttatccttttcaggaaatcaaaaaagtgaggaaatggctccaaaaacttagtactaatgtttgtgtgtctgtgtttgtgtgtgtgtgtgtctttgggagtgttggcaatggaaagaagttaaactgaaattgcatacactaagttgtaccaatattttgtgaatcaatttagataattctgtgctactaaattgggaacattatttattagaaaaaggacttccctgagaattgaggagttcactgtttggagtgatttgaccaactggttattttatcattctgcagaccttgatttaaaccacattttatgtccttatattccctccttttcatttgttgatattgatcctttgtttcacctttttaacccattccctcaaaatatgaaatgcttctttcttctttccaaggctatatttcccacctgctagtgactggattccctctctcctttgtgaacttgctctatccattgtaatttctctgttttgtatattctacaccttttatagtagctatttgatatcagcctatgttatcaggattctggtggttgcaagtgacaaatcaaatttgtaagtgtggaaatttattggttcacaaatttgaaaagaccaaagcaataattagttttaaacatgactgcatccatgggctcagatgataacatttttttctttcatctcttcactctacttccctctatgtgttgatcaaacttatttccaccaaatatggtctagttatatatgggacctggagtgaccatagatgtcttcagaccttatcctacaagccaggcattgcagaagacaggacttctggttgtccacagtcagttaatggttcttaagttcttgaactactgctgaaatcggtagcaaggaaggagtcattttctaatagaaggatgtttttgctttttcatttgaataagagaagaaatgctgaatagtgaagcaataggtgtcctctaaatatatttgtttcttaacatagaaagtaccttgggtaggatagaaacataaaagaggaagagaatttggagagattaaaaatctgatttgtgacatattgtggggtttctgtatgtctggtgataggtagctgaaaatacagattgcactttaggataatgaaattcactgtcttcaatatattactctctatttaattatatcttttctggaaataatctctctttggtaatctaaaggctgcccacatttcactttgctcttcctacacatgttgctgtgatgaaccttttggaccaaaagtctaatgagtatctttctcctatgtttattaaaaacagcattcttactaaaagtaatgactacttttctttcttcatagtacttgattacattgtctttgacattattcaatgctgtatttccaactccctatcaacagacacacacaaatcacaatatctcacaaatccaatttttaataatcacttccagattcctcctctttctatgtttttatcatattcaacgattttaacaattcttttttaaaacatctagggaagtcagtcaatattggctttcctctttctcatgtgtacattcagcatcccaacaaatcccacctatgttagacttctttagagtctcttctctgctttccaacaacattgcaaacatttcatgacgagatctttcttaaactattccaacagctttttaacagtctgcagtcttcattcttttctattccaggcagcaaggcacaaagctatttgatttatttttctttttttttcaagtagacattttctttttaataaaacagagcgcaaatttaagagtcttgtaatgggattcaacatttttccttcacgcagctcgggtgtgagtacctggctttaaagcaaatccagtatgtgaaaatggggatgtgtacccatcagatctggggcaagagattcacttcacagagtgaatgcttcttttctttaccagaggaattttcatagtattctctggaagggataagctttcctcatacatataaacacttagtaaatttttaatttaagtacactctttagacaagtgctgtataaagagaagactcagatcaggcagatggtgcctattatttttcaagcaattaccttaattcaaatgaaatccaaatgttttgtcaacatctggttggcattcagtgccttgcctagattgttcttttttattttttattttttggtaatagaaaaatttattttttcaaattaacatgttttcttctttgtttattatactttaagttctagggtacatgtgcacaacatgcaggtttgttatatatgtatacatgtgccatgttggtgtactgcacccattaactcgtcatttacattaggtacatctcctaatactatccctcccccttccccctaccccacaacaggctctggtgtgtgatgttccccttcctgtgtccatgtgttctcattgttcaattcccacctatgagtgagaacatgttgtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctgtcattggtggacatttgggttagttccaagtctttgctgttgtgaatagtgccacagtaaacatatatgtgcatgtgtctttatagcagcatgatttataatcctttgggtatatacccagtaatgggatggctgggtcaaatggtatttctagttctaggtccatgaggaatcgccacactgacttccacaatggttgaactagtttacagtcccaccaatagtgtaaaagtgttcctatttctccacatcctctccagcacctgttgtttcctgactttgtaatgatcaccattctaactggtgtgagatggtatctcattgtggttttgatttgcatttctctgatggccggtgatgatgagtaagttttcatgtgtctgttggctgcctaaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttcttccattttgtgggttgcctgttcactctgatggtagtttcttttgctgtgcagaaactctttagattaattagatcccattcatcagttttggcttttgctgccattgcttttggtgttctagacatgaagtccttgcccatgcctatgtcctgaatggtattgcctaggttttcttctagggtttgtatggttttaggtctaaacatttaagtctttaatccatcttgaattaatttttgtataaggtgtaaggaagggatccactttcagcttcctacatatggctagccagtttccccagcaccatttattaaatagggaatcctttcctcatttcttgtttttgtcaggtttgtcaaagagcagatggttgtagatgggtgttattatttttgagggctctgttctgtcccattggtctatatttctgttttggtaccagtatcatgctgttttggttactgtagccttgtagtatagtttgaagtcaggtagtctgatgcctccagctttgcccttttggcttaggattgacttggcaatgagggctcctttttggttccctatgaactttaaagtagtattttccaattctgtgaagacagtcattggtagcttgatggggatggcattgaatctataaattaccttgggcaatatggccattttcatgatattgattcttcctatccatgagcatggactatttttccatttgtttgtgtcctcttttatttcgttgagcaatggtttgtagttcttcttgaagaggtccttcacctccattgtaagttggattcctagatattttagtatgtttgaagaaattgtgaatgggagttcactcatgatttggctctctgtttgtctgttattggtatataagaatgcttgtgaattttgtacattgattttgtatcctgagactttgctgaagttgcttgtcagcttaaggagattttgggctgagacaatggggttttctagatatacaatcatgtcatctgcaaacagggacaatttgacttcctcttttcctaattgaataccctttatttctttctcctgcctgattgtcctggctagaacttccaacactatgttgaacaggtgtggtgagagagagcatccctgtcttgtgccagttttcaaagggaatgcttccagtttttgcttattcagtatgatactggttgtgggtttgtcataaatagctcttattattttgagatacatcccatcagtacctaatttattgagagtttttagcatgaagggctgttgaattttgtcaaaggccttttctgcatctattgagataatcatgtggtttttgtctttggttctgtttatatgctggattacgtttattgatttgcatatgttcaaccagccttgcatcccagggatgaagcccacttgatcatggtggataagctttttgatatgttgctggattcagtttgccagtattttattgaggatttttgcatcgatgttcatcagggatattggtctaaaattcttttttttgttgttgtgtctctgccaggctttggtatgaggatgatgctggcctcataaaatgagttagggaggattccctctgttcctattgattggaatagtttcagaaggaatggtaccagctcctctttgtacctctggtagaattcggctgtgaatccgtctggtcctggactttttttggttgataagctattaattattgcctcaatttcagagcctgttactggtctattcagggattcaacttcttcctggtttagtcttgggaggctgtatgtgtccagaaatttatccatttcttctagattttctagtttatttgcgtagaggtgtttttagtattctctaatggtagtttgtatttctgtgggatcggtggtgatatcccctgtatcatatttgatttatttttctacatgaaaaaatttgtcttttaggaagttaaggattttttaaaaaccttcattgtgtctttttagcttacaacataaggttcaaaattcttagtatgaaatttttaaattattctcattttttctcaatagtcttgcaatttcacattccatatttcaaccacactgagaaatttgccattctcccaacatatcattctccttaatgcttcagtatctgcgctcatattgttctttctactagcagcacccttttttattgaatttgatctcagtcttctaagccataggaccaagaaagcacctagcacatagcaaatggtcaataaatatgtgttgcatgtatgaataaatttgatcatacttaatttatttttgttttacattttctaaattggaatcataatttatgccttgagtacttcacaggcaaattcaagaaggttttgttaaaattgattaattaaaatttatgtcttaattagcctaacgtagtgaacttgttccataaaacacagatagaacaggagccaaaaatactatgggaaaatcattagaaagttgttcttaataaatcaaaacaaaggtaattgaagtgaaatgcagggttctaaacaacagatacattctcaaaatatgactttcagtacatttcacaaaataactaagttttcccgctacccctttatgttcctgtcacttttaaaaatgatcttttgagctttatttgtagcacagcaagtctcagagagttggagaagggaaaaaatgctttaatcttcatctttttccctcttatagatttataggtggaaagttttcttaaaagaaacaatgtatacaccacctaccatcagatcaggaaaacaaaacaagcgtttaattaactgtcttagacagaacattggaaaggccaactccaattctgtctacctattccccagctttgggacaaatgttgcctttatactgccctcttgttttctcacagtgtttgtaatgcacggaaaaaaaaatactattacattgattttcaaatgctatgtagctgcagttttaaaaataaacagttgttttttgtaatcttcaaaaatgctttaactgattaaaagactacttctcacatatagataattataaaaacatgtaatcaatttttataacaaacctaagcactatgtcatcataaaaatgcacaacccttcaaaagtagttttgaggattttttactaaaaccagattctgaaacaaaaaattaacttcaaaagacagactaaagcaatgacctcatgctactcactacaaagaggcaacagtagacaatagggtcatcaaaatgaaaaccatgccaagctaaatgaaaggaagacaataagctttctttctttcaaaaaaatggtttcatcagcatttctaatgacatctcaagggttatagatgaaaggtagaccaaatagctaggtggagttgttggttaaatgttttattttgttacaattaattttcaagttaaaattacttaaagtggtcaagttctaattaaatattaaaattttattcagttatagccaacttataaatatttactgctagaagcttacaaacaacatgctcagtttaatattttccatttgcaaagtatgacacaattgaagaaacaaatgggacccaattcattatttctggagtattattttatatttatgaagcttgttttataactatcaccttgatgtctagcacatattaagagctcaaatacttaatgttttattgatgtgccattgcatggcagatctcctgagtggtagatttaaatttgctcccaaacttcaatttaattctcatttcctaggccatcagcatttccaataaacaaaacaaggctttggcatttctctaaataacgataaaatgagtttacatgtttggaaaagttatttttctgcatcaataatgttacacattaatctcaataagagatttttttctttttctcaagtcagtagccacattctgctttttctgtttcagataacagtctttcaaattcgcgtcttggccacaaagagtagacatactaaaaatccattcttaatgcactcttcccctgtgactgatgactattccacaacctctcatctctaccaaaatcggcagcactatctccctgcttcattcttttttttttctttttattttattttattttctttttctttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgcgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttactccctgcttcattcttaactggtgacatttttcctatttaagtgagaaaatacacataatgatccttagaagacatgttccccaaactcccaacaccatgtaactgacctgcttacttttgtacttatctcttttaactgcagtctaatattatgaaaaagtttgtgtatccatctagagtcttatatcaactcttccacttgcagttcttcccttctcatttacttattcaggtttcccttgtaggacatcactctaccctgactttcctccattgttgctaaccactctttttcagtctcactgtggattccttcacatctcccatcctccaaatattggaagtgttcttgggctcaagccatggtgtcctctcacttctatccttatttatccttagtaatctcttctgttctcagtgagacagagaatagaaaactctcaaatgtgtagctctgaaatgaatttgtctcctgattccagattttatgtaagtcaacagacttgcatctgtatttggacgtctaataggcatctgaaaattatctagaccttactcttgatctttcttctcaaaaacctgtttttcttcaagtctttccattccaaggaagtggaaagttcagccttccagcttctctggccaaaaactccatcttctctttttctttctcattacacatgaaatcaggaaaacatgtttctctactttaaaaatttagcaatttccaatcaccttgttaacacccagaaatactgtaatagctttataaccaatctacctgcttctgcccttgtacatctcacttttaatctattcccaaaagagtagtcaacttattcttatgattgggtcaaaaccctccagctcttttccatatcactcaaagtagaaatcaaaatggataatgatctggtgcttcctgctgctttctttgaatccagtgctggctagacacatcaaccttctagctactctgtcctccaggctcttgcacttgtagttctctttggcttgaacattctggccacagatatctacacagtttattcccctctctatttcagatctctgatccaattccatctttcttaatatagtcttttatacctattaaatttgcaatctctttctttgccatttcacatttctcatttccaaccattttaagtagattttattgtgttatgctagatattttacttatgaactttttattttctccctacaagaaagtgagctataggaggataaagacttttctttatcccacttatgaatatatccccatcgcctagaaatgttacctgcacctactaggcattctaaagtgcaaaacctcttggatttgcaaagacatggaatcaacccaaacgcccatcagtgatagactagataaaaaaatgtggtacataaacaccatggaatactatgcagccataaaaaggaatgagagcgtgttctttgcagggacacgaatggatctggaagccattatccttagcaaactaacacaggaacagaaaaccaaacaccatatattttcatgtataagtgggagatgaaaaatgagaacacatggacacagggagagaaaataacacacactgtggcctgtggcaagggtgtgagggtagggagagcatcaggaaaaataggtaatgcatgctgggcttagtacttaggtgatgggttgataggtgcaacaaaacaccatggcacgtggttacctatggaacaaacctgcacatcctgcacatgtaccctggaacttaaaataaaaattactccatgtgcagttatataggtaaaagaccccttggatatacacacatgtagtatatataagtttagtgttacactggttcagaataaaaagtctcagagactatactttgttttataaggggttcactaaaatataaacaaaaataatttcaaatgtacaatataatatgtgtttatttgggagactacagtggacttctgagataaattatgagataaattgaaaatatattttaaaatgctattttatgcatgtttcaaagggaacatttaactatgtctgtgacaatcaaaataaaatcataaaaaattcagtaaatgtaattgagttttgctttctttgaaagtatatttgttaataatcacaatacctctttaatggatatttgactacattttaaataacattaaaattaatttcctagcattaaaatgtttgtcaactatatcattttaaacttaatcatatatttgtacttagtatgactctagaggtattctgtagtctttttatcactttaatctactaaacaatgtagacagtatactgtatatcaccaagaagtgttcacaagttgttttttccctccttctgaaaaatattatgtctgtgttttagtgtatatgtttgtgtcttttgggctataggtgtacatctggaatttgctagcattagcacacagaaatgtacactcaagtgatttgaagcaactttggtctgttgtcaaatttaatagacattttcagtttattatgtatacaaatatttattatatataaatatatacaaaaatataaaatatataaacacataaatataaaatgttatatatagatacaaaattttacatacacacagaagagaaattcctcaaatgcagagctaatgcaccaataaacaaacatttgtgagtatatttagcttattagtcatatctgatgctaagatctaccatcaaaaacatctaaaggagtttttttcttttttttttcttttttttattattatactttaagttttagggtacatgtgcacaatgtgcaggttagttacatatttatacatgtgacatgctggtgcgctgcacccactaacttgtcatctagcattaggtatatctcccaatgctatccctcccccctcccccctcccccctcccccctacccccaccccacaacagtccccagagtgtgatgttccccttcctgtgtccaggtgttctcattgtttaattcccacctatgagtgagaatatgcggtgtttggttttttgttcttccgatactttactgagaatgatgatttccaatttcatccatgtccctacaaaggacatgaactcatcattttttatggctgcatagtattccatggtgtatatgtgccacattttcttaatcccatctatcatttttggacatttgtgttggttccaagtctttgctactgttaatagtgccgaaataaacatacgtgtgcatgtgtctttatagcagcatgatttataatcctttgggtatatacccagtaatgggatggctgggtcaaatggtatttctagttctaggtccatgaagagtcgccacactgacttccacaatggttgaactagtttacagtcccaccaacagtgtaaaagtgttcttatttctccacatcctctccagcacctgttgtttcctgactttgtaatgattgccattctaactggtgtaagatgatatctcattgtggttttgatttgcatttctctgatggccagtgatggtgagcattttttcatatgtttcttggctgcataaatgtcttcttttcagaagtgtctgttcatatcctttgcccactttttgatggggttgtttgtttttttcttgtaaatttgttggagttcattatagattctggatattaaccctttgtcagatgagtaggttgtgaaaaatttctcccattttgtaggttgcctgttcactctgctggtagtttcttttgctgtgcagaagctctttagtttaattagatcccatttgtcaattttggcttttgttgccattgctttcggtgttttagacatgaagtccttgcccgtgcctatgtcctgaatggtaatgcctaggttttcttctagggtttttatggttttaggtctaacgtttcagtctttaatgcatcttgaattgatttttgtataaggtgtaaggaagggatccagtttcagctttctacatatggctagctagttttcccagcaccatttattaaataaggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcaggctcttttttggttccatatgaactttaaagtagtattttccaattctgtgaagaaagtcattggtagcttgatggggatggcattgaatctgtaaattaccttgggcagtatggccattttcacgatattgattcttcctatccatgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctttctgtttgtctgttattggtgtataagaatgcttgtgatttttgcacattgattttgtatcctgagactttgctgaagttgcttatcagcttaaggagattttgggctgagacagtggggttttctagatatacaatcatgttgtctgcaaacagggacaatttgacttcctcttttcctaattgaataccctttatttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcttgtggtttttgtcattggttctgtttatatgctggattacgtttattgattttcatatgttgaaccagccttgcatcccagggatgaagcccacttgatcatggtgggtaagctttttgatgtgctgctggattcggtttgccagtattttattgaggatttttgcatcaatgttcatcaaggatattggtctaaaattctcttttttggttgtgtctctgccaggctttggtatcagggtgatgcgggcctcataggatacccaggaattgaactcagctctgcaccaagcagacctaatagacatctacagaactctccaccccaaatcaacagaatatacatttttttcaacaccacaccacacctattccaaaattgaccacatagttggaagtaaagctgtcctcagcaaatgtaaaagaacagaaattataacaaactatctctcagaccacagtgcaatcaaactagaactcgggattaagaaactcactcaaaaccacttaaccacatggaaactgaacaacctgctcctgaaagactactgggtacataacgaaatgaaggcagaaataaagatgttctttgaaaccaatgagaacaaagacacaacataccagaatctctgggacacattcaaagcagtgtgtagagagaaatttatagcactaaatgtccacaagaggaagcaggaaagatccaaaattgacactctaacatcacaattaaaagaactagaaaagcaagagcaaacacattcaaaagctagcagtaggcaagaaataactaaaatcagagcagaactgaaggaaatagagacacaaaaaacccttcaaaaaattaatgaatccaggagctggttttttgaaaggatcaacaaaattgatagaccgctagcaagactaatgaagaaaaagagaagaatcaaatagacgcaataaaaaatgataaaggggatatcaccaccgatcccacagaaatacaaactaccatcagataattctacaaacacctctatgcaaataaactagaaaatctagaagaaatggataaattcctcgacacatacactctcccaagactaaaccaggaagaagttgaatctctgaatagaccaataacagtagctgaaattgtggcaataatcaatggcttaccaatcaaaaagagtccaggaccagatggattcacagccgaattctaccagaggtataaggaggaactggtaccattccttctgaaactattccaatcaatagaaaaagagggaatcctccctaactcattttataaaggagtttttttcaagatgtttatattttaatgtctgtaacattaagtctaatctttgttctaccatcagtgttttgtagtaaatttcaaaaatatcatgaccatctgcaccattctttcacttcatgattgatgttgaaaatttaacagcataattgtattctgaaaaggtagtcatatcatatatcctgttgttcatggatttatattgtggaatgcattactttaaggtattcttctttaagacctgtatataattatgattgctatagatgataagttggcatggttataaatttattatcaaagttgggtttaaaatattaattaataatcttttattttggctcccaggggagaaaaaaccaatagctctgtattaattattttatgagagagtcttacaaattttgaagaactgcattttcatcagcattttctcaaatgatgtgaaaacatttaaaggttactaactagtgctacattgcagtagaacccataagaaattatatgtctgatattaacatgaatttatttcaaccagaataatttaggatgatttgtaaaaattcataaaattaggagttttttagataatacaattaaaaatgtaaaataataaaaacaactatcgtttctgctctatatgatgtttataagcctagattactacacaactctctgcttgaagcatatggcaaagtcaagtataatatgaatatggataacaacaaaaagtgccatggcaagaatcaaaatgaaataaatatctctgtagactttataaacaaggtctttctgtgttgcccagactgaagtgtagtggttggatcattgtctatagactataaacaggtaagaaacccaaagtaagatatagtattaatgggctctggatctaaaagcaagcaaaagtacttccagaattgtaaagtaaaggataataaatataatccactcagacagagtccaaaagtctcagcttaacatgtggccctggggtaggctttcccacagtagaaagaagagagcctaaaacaatgtaaccttttgggaggccgaggcgggcggatcacgaggtcaggagatcgaaaccatcccggctaaaacggtgaaaccccgtctctactaaaaatacaaaaaattagccgggcgtggtggcgggcgcctgtagtcccagctacttgggaggctgaggcaggagaatggtgtgaacctgggaggcggagcttgcagtgagccgagatcccgccactgcactccagcctgggcgacagagcgagactccgtctaaaaaaaaaaaaaaaaaaaatgtaacttaaacagtggcaaagcacaaatctggttactgcttttaaccagatcccagcctatggaagctaccaaattcatgactatgaaatgacacatgtgcctatggtattgcaaatatcatcaacacagagaggctaattactacctaagacatgatttggatggaggccccaaggacaggtaatttaaaaacttattttaaaaaagttgacaaaaataacaaaacaacaacagcaaaaaaagactttccactcaacgtgaacctcaaaataaaatgccaaaacaagtaagaaatcaaataataaatgtgatgggctgaataataccccctctcctcttaaacaggaggtcctaatctctgcaatctgtatatgctatcttatttggaaaaatggtctttgctgctgtgatcaaaatgtgtgtcttgagggggtacgattaacctggattcaagggggttgtaaataaagtaaaatatgtccttataataagaggcagagggatatttgatgatacacagaagagcctcttttctggtgcgatcatggaggcagacactggagtgatgcagtcacaagccagggaatgccagcagccaccagaacctctaagaggcaagacccagagtttcccctagaccctctgaaggaagcgtggccctgccaatatcttgatttgagcccagtgaaactaattttataatcctggctgccagaactttgaaagaataaatttctgttgttttaagctaccaagtttgtagtgatatgttatatcagccataggaaattaatacaataagagatacagctaagaaaaccaatcagaacatgaaattaaataaaattaattgtctccataatgaattcatactctgaaaagacaaaaatttgaaatatgttcaggatactttaaacattcgataaattaacaacagaaggtcctgaaagtaatcccaatgttgtcataaaaattattttataaaaaaagaaaattaaaatattcaagaagaatctctaaaactgacactactgaaggaaatattaataaattaaaatgtggtattgagaagcattaaaaaaagagatgaaagttttgtaaaaaacagttaagcatcaggtggttccaatgatcacataatacttggtatcacacgtatgcttgcagtaaaaaaactataaatgtgtatgtgtattagagcccattaacactatatcttgctttgtgtttctgatgtatttatagtgtgtggactacaaatgagccactgcactccagcctgggtgacacagcaagaacctgtctatataatctgcagggctatttatttcatttgatccctgctgtgtcactttttgttgttactatttatattcacattgtactcggctttgccatgtgtttaaatcagagtgttgtgtcatgatttcagcttataatatatcatctagaccagaaattataattgtttttattattttatatttttaattttattaactaaaaattccctaatattatgaatttatacaaattatcctatatatacatacatatacagttgaccctaggtagcatagattagcattgcatggggccacttatacatagatttttttcagtaaatttattgaaacatttttggagacttttgatggtttaaaaaacttcaagtctcagacatactatgtaacttagaaatatcaaaaaggttaagaaaaagttagatatgtcataaatgcataaaatacaaggagatacttgtctattttatcatttactgccataaaatatacacaaatctgttataaaatgtaaaaatttatcaaaatgtacacacacagaccatacatagccccattcacagttgaggtaaatgtaaacaaacacaaagatgcattattaaatcataactgaataaaagtgaccgtagtacatactatattgctgtaataattttatagcaacttcctgttgctattgcagtgagcacaaatattgtaagtatccacttaaaaatgccttgtgatgctgatcatcttcatgtgggaagttcatctctccaattgcctattgcagtaaaaaacgatatctctcagttctcacatatttttattgtgttcagtgctgtaccttgagtaaccatgggacccatatgaagtagcactagtgatgccaaaagtgctctgcaaaggaaaaatcatgatattataggaaaaatttgaattgcttgacatgtaccatagattgaggtctgcagcgtggttgcccactatttgatgataaatgaacacagcataaggaccgctgtaaaaaaagaaagaaagaaaaggaaactcacaaagccatcattgcagctacctcatcagctggagaaaccttgcagtttttgtgaactaccatttttatctcctctggaaagtgcaacttttatgtgggggcaggattgctataagaaaggcacatctgtagactctaacaggatttggaaaaaaaataaagttattatatgatgacttcaagcaaaagtaaggtgaaagatctaaagctagctaatttaatgctaacaaaggatggtgtgataattttagaaacatttttgattaaaaaaaaaatcaagatatcaggacaaatggcttctggcaaccaagtggcagcagatgagttctgaggggccattaagaaaataattggaggcagggcatggcagctcatacctgtaatctcagcactttgagaggcggaggcaggaggattacttgagcccaggagagcaaggttagtctgagtaatgtagtgagaccctgtctccactaaataaaaaaatttaaatttaaatttaaaaaaaatagccaggcatggtggtgcactcctatagtcccaactatttggaaggctgaggcaggaggatagcttgagtcctggaggttgaggctgcagtgagctgtgatcatgtgactgtactcaagcttgggcaacagagcaagaccctgtcacaaaaaaataaaagaagaaaataggctgggcacggtggctcacgcctgtaatcccagcactttgggagcccgaggcgggtggatcatgaggtcaggagatcgagaccatcctgactaacacgatgaaaccccgtctctactaaaaatacaaaaaaattagctgggcatggtggcgggtgcctgtagtcctagctacttgggaggctgaggcaggagaatggcatgaacctgggaggcagagcttgcagtgagccgagatcatgccactgcactccagcctgggcgagagagcgagactctgtctcaaaaaaaaaaaaaaaaaaaaaaaaaagaagaagaagaagaagaagaagaagaagaaaataaaatgattattgaagagaagggatatctgcctgaacagatttttaattcagacaaaagtgccctattttagaaaaaaaaagccacaaaggacaattattagtaagaaagagaaatgagtaccagaatttaagataagaaggaataagtttacttttctgtgcaaatgcagttgggtttgtaatcaggacttcccttatccacaatgcttttaaacctcaagtcttgaaagaaaagatagacaccagctgccagtttttgttttacaagaaaacctggacaaagcctccacctcttttgcctctgtcaccctgagacagcaataccaatccctcttcttcttccttctcctcagcctactcaatatgggcacaatgaggatgaagatttttatgatgatccaattccacttaatgaacactttttctggattggttcaatcagtgttttctccctgaagtcaggaaggtgtttccactaagagactacatttctaaagttcttttgatgttgaaaaatgcccctggcttcccagaatcccatgaattcagcaactaaggtgttgaggtggtctgcttgtcctcaaatacagtgtctcttctgtagcctctaaatcgggactttaggactttatcattaggactttaaggctcattacacacaatcctctatggaaaggacaaagtgcaattctgtctcaaaagaaaagaagaagaagaagaaaagaaaaaagctgtcaacagtatgaaagataaacctgaaagtgagaacaacatgaaagtctgaaagaattatatcattgaagatgccatcattgttatagaaaaagctgtgaaagccaccaagcctgaaacaattaattactactggagaaaactgctgaaatattgtgcatgacttcataggatttacaacagagccagtcaagaaatgacaaaatagactgtgaatatggcaaaatacggagtcggtgaggttttcaagatatcgatcctggggaaattcaatagctaacagataccaatgagaggagttaacagaagacaacttgctgaagatgaatgcttccaagctaatgctggacaatgaggaagaagacatagaagaagcagtgccagaaaaagaatgaccttagacaatctgtctgaagggctctgattattcaagaccacttttgtgacatgggcccttctatcatatgagcattgaaactaaagaaaatggcagaaatattgatactaaataaaaatattttttagagcaattgagaaagcaaaatatagacagaaatacaatgtatttccataaatttacactaggtgttccggtctctcctgcctccccttccaccttctccacttcttttgcctctgtcacattgagatagcaatgccgacccctccttttcctccttctcagcctactcaatatggacacaatgaggatgaagatttttatggtgatccacttccacttaatgaatagtaaatatattttatttttcttataattttcttgataacagtttatttttccagctttaagaatataatacatactatatatgacatacaaaatatgtgttaatgaatgtttatattatttgtaaggcttctggtaaagagtaggctattagtagttatgtttttggggaatcagaagttatactcagcatggggttggtacccctaacccctgcatttttccatggccaactatatatatacatatgtatacatacacgtgcacacacacgtatgtatgtattcagacattagagagctcaaggctattgtctttgtgagaaaggaggtaagtgacatgaatctcaaattttctcagattttctccctgaagtcattttctgaaggttgtggtgccaaaaaataaagctaactctagcagcaacaatcttgcagggtgtcagagactaatagtaaatttctggactattaaataaactaatggttaacggataaactatttgttgggggcacctaaagaaaactctagaagactggataggatagatatttccctcaggccttggctaacttttgagttgctcacaaatgtagtgagattccatagtactagataaaacagtcagactaggaggctgagaaatgagtaaaagttacacaatgctgaggagacactaaaatttggatccagccaaagggagaaacctcagtgaacactgggcatttatgtgcaaactcagaaaaaaaatcttgaaataagatcaaatatctagcagtaagaacaatgctaaaataagctttccctaacaaagcctaaaactaagtctcaacagcatcaaagtatttcagataatttaatagattttcaggaaaaaaaaaaccacataccactttctagcaaaagataaatatccagagcctgtacagtatatcattacaatgttcagcataccatcaaaattactagatatgcaaagaatacaaccaaagatgatctagatattacagttaacagataagggcttcaaaataattatgcttaatgagttgaaaaaagaaaaatatgagtaaaatctatgtatgaaagtgtagtaatttacacagcagaaggtaagaatactgtatttaaatagaaaatgtttattgtgacgcataaagagaaaaaaatggaaagaaccgataagaatatgaaaatgtgggtagaacacagtcagaagatctaacagatatataaggagttccagaaagaaagaagagagagaaagggacagaattaatatctgaagaaatagtagctgagaatttttcaaatctgataaaatatattatctcatggattcaagcaactaagcaaaccatcaaaacaataaatacagcaaaaactacaactaagcacaaaagaacacagctgacaagatctacgaaaaagagaagaccttataagacaggttacttttaacgatgcaataatcaacaataaagcttttggcttactttctagcagtaaacataaaataatggaaacacatctttaaaatgttgaaagaacaaataattgtcaaccataatttgacactcagatgaatccttcaaaaatattgtaaaaataattacatttcaagaaaacaaaaaaataagactgaagggattttcggcagcccacatgtgcataaaaatactaaagggaatgattcaggataaaggttaattatggcatgtagatgcatgaacatgtagaaaaaagcgaagaacatcagaaagggtaaatatattggtaaatataaaagatgattgacttttgaagaaggaacaataaaatatatttttgtatctctaaagtatgataataataggtcaatgagaagaaatagagtttcattatggaaaagcaaaatattattaaaagtttcttgcattgtttttagaagtgataaaaatgctaacatatggtagaccataataagttaagagtgcatactttaatctctagtgtgaatactaaaagaataatgaaacaagacacaaattaaaagaaaatagaggaggtaaaatgtaacgataaaatgatttggttaatctattacaatggtaagaaatgaagaatgaagaaacaaaacaggtagaagaaattttaaatattagcaaagtagtagccataaactcaactgcagttgtcgttacgttaaatataatggaggaggagtgcagcaagatggccaaatagaaggctccgttgatcgtctgccccataggaacaccaaattcaacaactgtctacgcaaaaaaaaaccaacaaacaacaacaacaaaaaaccttcttaagaataaaaatcaggtgagcactcacagtatctggttttaaattaatatccctgaaagaggtactgaagaggatagaaaaggtagtcttaaattgctaatgccacccctttcccacccctagcagcagccatgtggtacagagagaatctgtgtacttgagagagggagagtgcagtcattgagagacattgcattaagctcagtgctgccctgtcatagcaaaaagcaaaacccagctgaactcagctggtgcccattcatggagggagcatttagaccagccctacacgaaggggaatcactcatctcagtggtgggaacttgagttgctgcaagccttgtcaccatgggctaaagtactctgtggcactaaataaacttaaaaagtagtctaggccacaaagactccaactcttaggcaaggcctagtgctgagctgagctcagagccagtggacttgggggacatatgacctactaagataccagacaggtggctaagaaagcatttgcaccatccctttcccaatcccaggcagcacagcttgtggatccaagagagatttcttcctttcacttgaggaagggagagagaagagtaaagaggactttgtcttgcatcttggataccaattcagccaaagtaggattggacaccggtcaggattgtgaggccacccttccagtccctaactgggatgatgacatttctagacataccctaggccagaaggaaatctgctgccttgaaagggaggaaccagtttcaggaggatctatcacttcctaactaaagagcacatgggcacggaataacaggcagcaatacccagttagtatcaaaaacctttgatgagactctgagatgtgctggcttcaggtgagacccagcacattccaagatctgatggctacagtgagagagaacttctgcttgagaaaagcagaaggaaaagcaaagggaacactgtcttgcaccttaggcaccatcccagccacaatggagtatagcaaaagtgggctcttggggtccccgatttcaagctttgactctttgatggcattttctgggccttcctggagccagagagcagcccaattcactgaaaggtgggtcccaggcctggcagtattcaccacaagctgactaaagagccctttggtcttaactgaacatcatcagtagcctggcagtactccccgggggtctgtagtggtggtagccattacacctttggtagtagaggctcctttgactgtagaaaggagaggtaaaagggggaaggactgtgtcttgtggtttgagtgccagctcagccacggtacaacagaacactagataattttctaaagtttctgaccagtccctggctcctggatggcatcacttctgagagccttgaatgaatataggtgatagttgggtagtagttacagtgagccttgggtaagacccagtgctgtgctggcttcaagtaagacctagtagagtcccagtggccacaggggtactacagtcactccaacccagctacaagtgactcaccacagagagactctgtttttttggaagaacataatggaagaaatcaagagtctctaactggtaatccagagaatttttctagattttatccaagactactgtggcagtacctctataggtctgcaagaaccacagtgttactgggcttggagtcccacctaatacagatacagcttagatcacaacacccaagtcctgtcaaatacctgaaaaatcttcccaagaagggcaggtatgaagaagtccagactgtgaagaatacaatgagtacccaacccttcaatgcccagacactgacaaatatccacaagcattgacaccatctagaaaatatcacctcaccaaacaaactaaataagacagaaaccaatcatattgaaacagtgatatgtgacttttcagacagagaatttaaaatagttgtttttagtaaactcatagacattcataacacagagaaggaattcagaattctataaggaaaatttaacaaagagattgaaataattataaagaattaagcagaaattctttagttgaaaaatgcaattaatgtactgaagaatggatcagtcttttaatatcagaattgatcaaacagaagaaagaattagtgaacttgaagacaggttatttaaaaatacacagaggacacaaaagaaaaaagaataaaaaaggatgaagcacacttacaaaatctataaaatagcctcagaggggcaagtctaaaagtgattggacttaaagaggaaagagagagagggattagggtagaaagtttattcaaatgggtaataatagagaacttcctaatcctagagaaagatattaatatcgaagtacaagaaagttatacaataccaaacaggttttacccaaagaagactatctcaaggcatttaacaatcaaactcccaaaggtcaaggataaggaaaggatcctaaaagcagcaagagaaaagaaacaagtaacatacaatggagttctaatatgattggcagaagactttttagggaaaccttacatgacgagaaagacaggcataagatatttaaagtgctgaaagaaaaacaaaatactttcatcctaaaagagtaaaaaattcctagtgaaaaaaattcttcaaaaatgaaagagaaataaggactttcccagacaaacaaaagctgagggatattaccaacaccatacctgtctgtcctacaagaaataataaaggaactttttcaaactgaaataaatggatgttaatgagcaataagaaatcatgtgaaggtataaaactcactggtaacagtaagtacacagagaaacacagactattttaacactgcaactgtggtgtataaactactctcatcttaagtagaaagacaaaaagttgaatgaatcaaaaataatagctacaacaacttttcaagacatagtacaataagatataaatagaaacaaaaaagttacaaagcaggagacaaagttaaggtgtagaatttttattagttttctttttgcttgttcatttgtttgtttatgcagtgttacatttttatcagcttaaaataatattttataatacagtatttgcaagcctcatggtaacttcaaatctacaaacatacaacaaatacacaaaaaatagaaagcaagaaattaaatcataccatgagaaaaaatcaccttcactgaaaatagacaaaaaaagaagtaaagaacgaagaccacaaaacaaccagaaaacaaattaaaaaatggcactagtgaatccttacttaccaataacatcgaatgtaaatgttatttacattctacaaattgttaaaattatcttaatgtaatgaaataattggatgaaaggtcaacataataaaaattaattgtatttttatatattagtaataaacaactggacttttttttgtaacatctgaaatagcatcaaaaaacctaaaaactcaggaacaaatttaaccaaaggtatctaggaccccacacttaaaactataaaacagtggtgagaaaaatttagagacttaaataaatggaaggatatttcatagttataattaaaagcatgagtcctgtgattatatacatctgtagttatttctactctattgtttcatgctttacatttgttacatttttctggaggtcattttttatcttctgaacttttgaatgttttaattttttttaatgatttggaagttatatatcattttttctattcattctacagttacccacagtatttagccaacatgtttaattatacacttttcttttagcttttttgaaatgtataatacgttattaataagtatggtcaaatgttctcaccacaaaaaagatgagtatttgaggtgatggatacgttaattagattgatttgataattccaccatatatacatgtatgaaaatatgacatttactccaaaagttatacaattgttatttgtcccaattaaaaataaaataaaagtaaatttttaaataaataaactgttttctttcaatgtctggaattactagatatttatatcctccatcagtaataatgcagaaatgggccaggcgtggtgtctcacacctgtaatcccagcactttgggaggtgtaggcaggcagatcacgaggtcaggagatcgagaccatcctggctaatatggtgaaaccccatctctactaaaaatacaaaaaaattagccaggcctggtggcaggcacctgtagtcccagctacttgggagggaggctgaggcaggagaatggcgtgaacccaggaggcggagcttgcagtgagccgagattgtgccactgcactccagcctgggcgacagagtgagactccgtctcaaaaaaaaagaaaaaaaaaaagaatgcagaaatggaaacatgagaagctcaattgcattttgcaatctccacctcttattttgagatcacatgcaatatttttccatttgttttaatttacacactattagttaattttaattaaaattgttttccggttttgttaaaagtttgtaccaacattcttttagctgaaattgtcctacccatttctatggcaactctgtcatcatttggtagtctgccttaagtgagtcaaggctcacattctttctcttcttggaggttcttctctctccttagattttgggttaattggttttcctgacactgcaactctttgatgcattcaagaaaagtagttacgattcagtagatcttctagccttttcttatggttggtgagcacagtgaccttatcagatttctgcattttaggtaaaaaccataaactctttaaactttaaactttaaactctgtaatgccaaatgtctttgtaaatagttatattttaccctcacatgtaaatgctaatttagccaagtacaaaatttgagattcaaaatgattttccctcagaatgatactgcttcattgtagcccagtaaccagtttcgataatgagaaatataatgacactaattcttgctctataagagatcagttgggtttgtttgttcagtgtttttttcagagagtttagaatttttctcacctatgttctgaaatctcacttgaaatatgtctaattgcttttatctcttgttactttttttttaaaaaaatgcttctctatacctgctgggtctcctcaatgcttcccttctgttctgatcaattttctcctgttaattctttgataattattttcctgtctctgttatttccttttatcactcttaattcactgatattaaaattttagggccttagtttcatgtcttaattctttatactatttttcatatatattaatgtatatgttaattttttaagttctgggagaattcctagttttactctttagctccattcattctgacattcggttctatctacattttttcctttcacacaattttcattacttattttggtttttccaattaatggggattcactttcatatatctaaggacattaattataatatttatgtgtttacttactctgtttcctcatgttctttgtgtgaggactttcatgatactagttttcctcaactgcttgccaattcttggcagtatataatttttgtatttgagaattcctgctgcctattctttgggtggtagttcaatatacctttcctgcctctgcaattatatgagcaccctgaatgtattaatgtattattatctggggattctgatagtttttattttgacagtgagggtttcttgcttcttctgagagtaattatctgggcccatttttatatttctctggtctcagtgcgtgcaccctatatttgttgtaggagaaaatatcactgctgcccactgctcagtacaagatgctatgtagtacagttgctcaaaatgcaattctgcagtgactcacctttcagattgcctcaaagctttcttgttgactcttactttgcatattccctggtaatttttctcaccatgaagaccatcttttcgtgcaaatgctttatactcctattttatgctgaatggtttttctccaaatctctttttgtttccatcagtttctcttattcctgaaatgatcaaaacaatcaatctgctaatggtactcttttgtgtttgtttttcacagttatcaataatttatattttataaattatactttgttctcattttatttgatttggggcatattgaaaaatacagattatgtacacagtctgcaaatttgaatcgatctcaaggtcctaaaaatatatttgacttatttagattaaaataggcccctttaatgtgaagtcaatctaagtacccatcaactaatgggtagataaagaaaatgtggtatatatacactttggaatactgttgagccattaaaaggaacaaaacaatgtattttgcagcaatgtggatggagctggaggacactattctaagtaaagtaacacatgagtggaaaaccacaaactgttctcacttataagtgggagctaagctttgaatacgcaaaggcatacagagtggtataatggactttagagactcggaaggagtagggtggaagagggaacggataaaaaactacacattagatacaatgtgcactacttgggtgataggtacactaaaatgtcagaattcatcactatataattcatccatgtaaccaaaaccacttgtacctaaaagctattgaaacaaaaataaatacatatgtacatacataaatacataaataaaataggctcttctaaaacactaaacttccttgttaaataaatcagttaatattgcaaaattcgattatacaggaaaaaaatctctatctattgatgattcttaatttatctagatttatagatatgtaattttaaaataaaatgtttgacctctttattttcatataatttttggtgttatgaagctttctgcttggctattagttctaaaaactaggatatatgatggatatccttatttaagttatgtcttgttagagagtctttgggaggacagaactccttctacttttgagagccacattttccctggctctaaagaataagatgactgtcgttttctcataaattgtaggtttttctacaaggctcattactgattcctttcagagctcattttcctacaaaatacataggagatctcagcgtcctaaaccagactaaacttttgaattgttgtgtgtagtagaccccaatacttgacaaattatccactccaattaactattaacgtaagttctttaatgtagagtctcagcatgtagcctgctaaatttttaaaaagagccagccacctttcctctccctaaactgtaaaacagagaacttaataggtaattctgtaacactttctgatagctttctccttaatgagctgctggcctgtgtctcagagtccacttccttaaatgagaagagcatggttttcatgtcaactattttaatattgacttcttttatactcattttgttaagaaatcaactgagtcaaatatgactacttatagtttttattgctttgcactaaccaataattatgtgtacaaaattgagcggtcaagaaatataagcttaacatagcccctcagctgtaaatgctttcatgaatactaaatcatataaaactatcttaattagtataggtagatgtgttctgcctgaccaggtcacaatttcaagtagcatgtactaaaactatgttttaattctccttttttagctcctttttaatggcttcctactaagttcaattaattggacacatgctgtcccggagtagcaaacttaaaaatatgtgtgtttttatgttgatgaaatgttttctctttagggtctaaaagttattaccagaggcaactggtcttgctgtctaaatagataagaattgcttactattaactatgctaaataataaccatcattcttaaaagttattctccaaaaatgaagcattcattttagtcatacatcagttctggagacaaacgtactggagacaaatgtacatagtccacagaagcctatgttgctatatctatgataggtaaatcgtaatatattttttgaaagagttgaggcccaaattaaatatgctgcagaactttgacatttctgagcatttatcactttatttgggggtagggtacctttccttttgatgtagtttcagatttacagaaatagtacaaagaactctcatatatccctagattcaccagttatttatattttctctatattctgtattactctctatgaagatatggatgtaatattttttctaaccatttgagaggatattggagacctttaagcctaaatattcatgtgcacttttgaagagtaaggacattattttacataaacacagagcaattccaaagttgggaaatttagatagcactatttttaatccccatattcaaattccataaactgtatcaataatattctttagagatattgtttcctgggtctaggatctaatctaggatcaggcattacatttacttaatttttttttttttttagttcctctaatctagaacactgttaacctatgcccatatgtctgcagtttctttttcttcaggtaaaatttccattcagtgaactacacatatttagagagttgacaaaggcctctatttcatataaatatatatatatatatcatatatatagtatatatatatatttcatatatatatagtgtgtatatatatctatatagtgtgtgtgtgtgtgtatatatatatatatatatatatatatatatatatatatatactttaagttctaggttacatgtgcagaacgtgcaggtttattacataggtatacacgtgccatggtggtttgctgcacccatcaacccatcatctacattaggtatttctcctaatgctctccctcccctagcccccaccccacaacaggccctggtgtgtgatgttccctctatttctataatcagcactactattaatatacaggacatctctgttctcctcaaaagtgggattacgtagtatatgctattttatgtttggcttttttagttcagcataatgactatgtgataatacatctgtgtctttgcatgtatctgttgttcataccttgtattacaaagcaataattaattatctatatatggcaaaaataacttattcctgtgttgacagctgtttagactgttacgaaaaagcttctttgtaactttttgtacaaattttattatatttggtgcatatgtattttcatatatatatttttagtaaatagaaacagaatcactatatcataaggtaaatatatgttcaattttactaaaacctggcaaaacctttttcaaagtggttgatccatattacatccctaccagctatgtgtgaaagttgccagttctaaagaacaggcaaaatggatcgatgtgaaaaaaaaaattagaaaatggattgtctcagggttgcgataatttcagagtgactaataaagtgaattttggacttaacttggagacctttatggcccatttttctcagataccacacctacttcttattaagaattccagtcagacttctcaactttcataatagatattccatccttcttttcacctctttgttttccaaagcttaagaactaccatatatatagattgctagcattttaaactcatgtgcaagattttatgagcaaactgtctgcttttcagtttttaatcacaaacttaactaagagaattgatattcaaggaagatggtctatttgaccaactattcatgtattactctaggaattctatgttatgtcctattatcaggtcacacagcccaaatgtcagttatctgtaacatgttattttgcatataaaaaatctatgttgctagattgcaattcaaaataaaagttcttattttttatttgcttgtttgacagttgaaattctattgatgtttataatgaaaatacttgcttttttctcctctctaggattctgattactatttcagttttattcatatatgccaactaaaggcatttctgaagtgaaatatcacagttttaaaccttcaaatacaagttaaaagaaaaatatccacaacaacaacaacaaaactcagctggcttattcagagtgcttttcagcaatttactcactttgggaatatctagttttctttgtggattaaacacgtctgacgtgactcactgctctaaaattcccagttttgaagtaatattttgttttatttgtcctaagagactgagggttaactgctttctcccatttagctcttaaaatgtatcagtttatttacagtatttaacatacatatattaggaccttcttattctataaaaatagaactacttgtttaattaaaccactaattgccttagccaaaggaaaacatcttactgaaataaatgatttgtcttggtaatagaagtgtcaaaagtgcaaatagatccctaattgctagataatttcccaacaattaattctgctgcttaagtattccccagctagctccatgttgcctctcattttagatcagcacatcaccatctcctgcttgattatttctttgcctccagtcttgcccactttatctacgctactacctttcatctttataaagtacagttacggccatgtcactctgctgtatgagacattccattgtcttccttctcataccactgtatagttcaaaataaagcctaacctctttatgttggcttaaaagcccttcataattcaagttatttctgtctcatctcttaccttcccctattttgcacccctactccatttataaccattttctagccttataaatgtccttctcttccatgtgaatctttgtgtatgccctcttttttttttaacctggaacactctacagcagcttttatacttcatgcacttaatgactactcttcctgtgatgtactactgagtagaggaaaaagttagagctatttttaattagtggtgaaggtaagcctctgacagcatgatattggattctgaagatgagaaaacagccttctaaggagaaatatgagtggtctagaaagggcagaagtcctgaactggggaagattatggcatatttgagtcatagaaaaaagtcagcatagctggagagcattggaatggagagagaggcagagtagagagaatgacagaagatgaaactggagaggtatatactgagtgcctaaatcatgtgtgatatcacagaccattccaaagaccttggattttagtctaagatcatttctaagccactaataagctttaatcaggcaaaaggcttaatctgaaaaaagttttgaagagattgctctgtttgtattgtaaacagtggatagaagtggaggagggtgaaattggcagctgagagatctgctagatctctctagcagtaggtggcatccaggaagaaaataatgatggcttgggtaggtgtaagcattgcacagggataaaagctactaatatataacttaggggatgagctaaacagaacttgctgaggaatagggagttgataaaaatcctcttatatttatgtagagaatttcagagattggaatttttcaagcgtgtttttttttttttttttttttttggtggtggttctctttttttccgcaacagtaacaatgcatcaacaaaaaattctgatagataccttaaacttaccacacacttattttgacagcttttcgtcttattttttagagtttagctgatctccttgataaacaagtttattcatggatggctgaaacatgcttattatttatatcaactaaataaagtggcctgcagtcgttgatcttgacaggacaatgcaatagctttcttgctgatgtgactcattattttctcttccaaactcaccctgtgaaccctatgcaccaccatcacaatttcctcaagaaccatttcaattaattttcttttctgcttaatatagtttttatagcccactatactcaggactaggtttatctttcaggcttcatttctcttttcttttcctcatgaatgcaatgtttcagctaaaaatagctagttagtattccttgaatcctccagaattttatcattattttgtctttactcttgcagtctttcacaggacatattaatatcgtatctctaaaacaaaattctactacccttagagcttggaatgagagtaatgcatagtagttaagaaaattagctttgcagttaaagaatcataggtgagaattctgcctctgtcacttaatagatgcgtgaccccagcaagttcttagcctaaggaccagtttccctttctctgagatggggaagatgagagtatctactttatgatgttgcactaaaaattaaataagatcttacctgcaacacattttataacattgtttgacataaattaagcaccgaacaaatgataggtatcaatatctttattaaggttcactttaaatgctatgactttatatgaaaaacccatggcatcagcttgaactatcaacttgaatgtgatgttatatattcccattgctgttatatatattatgagacatatatacataagcacaaacaatgtcttacatgttcattatcataaccaattgtctacatctgttgcatcattctttccacattctgctgtgcaataagattgtgtgtataccaaatatatgataattttttttgtcccatatccaattcttagataaagatttataccctcctttcacattgcttgtacctgtattagagttaagcctcagctctctgaactctacatgagagttaagcctcagctctctccaaccctgtcacagctatcggggacatggatggacccttggtgttagttgtttcaggtacattcttttcctccattacttagaaatcagagcctgagaatatgtcatcttgggcaatgttaacctagagcttggaatggccatgttcagatctaatgcattataaaatagaggaagttatgctagagagagagagagaaagagacagaagaatgatatagttgatcacagagaaggagagatgggagaccatgcagtcctttattgacagataaaataatttcaattcatagcttccttgttcctggtgtcagtccattttgcaatctagctacacttcctgccaggtcttttggtgaaatagcctatagtcttccatgaaattatcttcagttttagtagattttgttactaacacataaaccatctttgtaagaggccacatgcctatctccattcccttcaagcactgtagctgcatgaatatcttttccatcttcatctaggtcagtgcctaacacagagcagcagtaacaacctgatggcaataaattggttttaccattgctcacagtctagaatttaacacaatactattcaggcacaaaatcaagctgatttaaaagtaaatttaaattaattttctttgaaaacgttggtagtgttttataaaaatccttgagattttctctgagatcctgggctgggaattactatattaaaccaaagtgtagtaagtatcaaaactggctttacatatgagtgtgtctcatacatttggaaaaagccaagatgtttctggattgagatcttcttctagtaaataatagcttctttgaagctgtgttgtattccagacatttcacttattaaccaaggagaaggcagatatttgtatattgctggcatgaagacattctaaatttcacattctaaatctcaaatggatatttcaaagctttcatagttgtattttttgaaacttcaatttatgtagactagaaaatataactattttgaaatataatttaaaattattggtcctgtgaagatggcaatgtcgtgattccaagggagagtaatgatgtgttaaaaggtacacaaaaagttaatcagagaaaatagattgcagaggttaccagctagggctcaggagtcaagcagcttggacctcaaataaattctgtaaaattaattgctacttgtataattctgagcaagttatccaacatctcttagcctcagttttcttatcttaaacatcaggatgtagatgcaaatagtactcacagagtttgggaaaaattaaatcaagctatttaagcaaaagttttggcattatatctgacatgtgaaaatcttacaattcatgtgggctattggtggtatttcattgtagtaatcattatggacagattttcatctgattttacttttttcctggcttcaataagaattagatgaaaaagactataaaactgcatctgtgacaaaaattatatttataaattaattatgcataaacattgaaagggcaaactccaatattttaacagggatctttgttaataaagataagaaacattttcaattatttctgctggtacacatatattttccaaggctctactaaccaagacagacttaatttgccctcagcttaagtgaactttagacaggtttattccggactataggaccttgacttgacctccctttttagagcactttttaatgaaaacttttaattataaattatttatctgcctctttgaaatgtaaacattctataatccacaaatgtctttcccaaagtcctgggagtcatccctttgaaatataatcatggaaggacataggatcattgtctcccagtctctgtgggaccataggaacctaactttaataagcaacaattgacaagcacagatgacctaatctcactgatggacttctcccaaaacatcctccagtatttttccattagttcactcctgcctttaaaaattacctgccttagttcaatggggttgagttcaatttctctcccctatttcaatagtctctctcctttattgtaatagtcttgaatgaagccttccttgcttgtttaacttatctggtgcagttttgtcttttacattacaaggattatatctatggtaaaatagaagtgcagaggatgtgtgggtatgtgtgtgtatgtgtgtgtgtgtatgtgtgtgtctatctgtgtagacataagaaaatttttgttagctaaaaaagctaaagaggaactgaagttcaatgttgttaaagtgtttgtcttcaaacttatctcttaatagattacaatgattgtattttaggagaacctgctaaattcaaacagtcagctatgtcatggcagtatagtgtcagtcccagagacttagcagctaatagatttctttctaaagcacagacctcccatctaagtccaagtccccactggctactgatttatagagtagcatttggcaaaagacggtcttaatcttacctgggtctcattttcctgcttataaaagagaaaaaagaggttctgagaagaagtacaaaattcaaaattgaaaaaagaataaaatattttcacctagaaagattttctctcctttggtatgcaagacggacttgcattagagacagaatagcatggctggttagagccactctctaaagtgggctggctgcctggttatgcctttaagtgtctgtgcctccactgtgtaatgagaatgattctaacagcatttatgtcatagttttcttgtggagattaaagggattaatactaatagagaacttgcacttttaatgtgccttgtacatagtactttgaagtcatcctagctttatatgtttgctcttatatcattattattattaaatattttgatacacgttaaggagaaacagtggccaccagtcaatttgattttgaacatgaaagcagagtctgttatgattttcttttggcaaaattgtaggattttattataaccatgacaagatgagggtcacatgcacttctgagatcaagaaattactacatcatatagtttgaaagaaaaaatgtgttaacaaagtagaaaagaggctggtgtaattttgagtaggtagtgtctctgtcatagtgtccatttccaaggtaattaggtgttcttcctcaacatagtttgttgttgttgttgttgtttgtagcatgtcttttattaaatgactgcattataatttgaataacaaatttcctatagttgaaatattctggatagtttccaattttttatcattataataaatgtgataaacataaatgttatacatccacaagggaaataaaaacatataatgataaaatatcaatcttcagcagattattttgtaaattcttttttttccctatacttctggtattaatttttgaaagaggatattttttgatacacatatttatttgaagatccaatgacatttattcatccatagatttacatctatgtacattgaataaagatgtgtactttttatggtagccatttttattctgatactttgtaaagatactaaaggttagattgctttgtttaggaaaattaaaatgtatggctttctgaaattatcatttttaatagatgtaataattgtcccaattttgaattagtgtagttaatacagtttaggaattttgttttaaaatagactaaacaaaataagggatatataaagagcaccattaagtatcaccaaacagctgacttacccaaacagatttcatctccaagcacaatttgtatccaatcagcaaacaattcagagatcaaagaagatgatttttacctgaattacaaattacagttaattgcataatcatattaacgaaatatcttatcccattatcgttgtgtattcataatagttttctgagatttgaatgtgaaagcaggtcaaatacttcataaggaaggaaacagaaagaggcccatgatattttcacaaagtcaaggattccatgcatgaccgtgcctgtgtctcactctgctcttattaaaactcaacacctgcaatcattatttttgctttgacacataatattgaattttcaattttagttgcttaaaacattgtcatctcaactgatcgtgtcttttattttattttttctagaagtattgaaagctgtgaaattatgtgagtctggccttgagaagtaaaattttgggggccactgatactttagcactgagtttgatgaattctgctctatactcaaatatttccgaaggcaacaaaaacagcaaaagttatgtagttgactttctttgttaacttaagctaattttaggactgggtgtagggaagatacataaaaatgaatgaagaaaatacagtttatagaaatggttataacttgtatatcattccccaaaagaagcaatcacaggcaacttcagtagcggtttagaacacagatttaggaattatacagacattttgcccccaaacttagttccatcactattacaaggaacagccattgttcagatgtgtaatgataggtgagagatgcatttttagatgtggaactgcagaatgaggatgatgatacatatagaaatgtaattgctattgccaaattaccctctaaaaggactgcatgcatctgtttacactcccaagagtaaatgaatgtgcttgtttcttcatacactcaatgatactaggttgtataaaaacattatgacttagtttaatgagagaaaaacatgaagcctctaatgtttccattaaatttctttataagtaacattattttatttttaaaagtcagaataaatctaaggaaactttcttagtgcctctgcatttcaaactaaaagttttacataataaatatttgaagatataaagcacacaatgaaccatgcatagaatattagaaaaagtatagacataatccaaaatgtccttttaaaataatattttaaagtggttaattgcattcatgaaattattaagtcagttaaacactatccaagttttatataaacattctaaatttgcataaatgcacacatgtttatattctccttgaatttcatactttactggaaaatctgagaatggccaatattggaacaatgcagctcttcccacgtatttatgaaatatattgccacttaaattataaatttgattctagtggcaattcattcatttagagtatcttttcaagagattttgcattaactaaaagaaacagtatataaaatcttatttttgagcagtaagagctatatatgtaaagttttattcaaataattttaattttaaaaacaatacatttccagtcacgttatttgcctttacatgaggcactaattattgagaaaataactaatataaacttatagaaacatttgtttttatagttcagaaaatgagaaatttaaaaagaaattccactctgaaaatacaacccagtttatttaggaacacagataactcaagagttgatttaaaggaaaagatgcttgcacagccttgcctaataaccttttttcctcaagtatatactcagctaaaaccttagattcccaggttcttgcaattagtagggaggcatatgacaatagtttcccaaatgtgcttaataaatagagttgtacttttgaaaaacaaacacagaataaaagtatttttaaaagacttctgatcagtttcacttgcaagaaaaaaagtgagtcttctgagtatttttcaaatacaatgctccttactcttggaatatttgaacgctcttgacagaactatattttccttatttgtttgttctgcagtaccttcatgcaaaaataggtaaggcattagaaaagacgatgaatctctcaactgcctcatgctgttttctgtgagcaatactagtgaaatgcatgaaataagagatggttcattattttgagttctgaaaattagttgtgcatttaatagttctgtgagatcctattcagtgagaatattcagggcttgttttgataacaaagtcaaatttgattcagttagactcctgaaggaagttgggaatataaaggctaagtcaacatcctaataggaattcccagttattccctatatgcactggtatttttgcattctagagactcaaatatattactaacagttaaataatactgatatttttctgcaaatataattacctctttcttttaccaccatctgctcttctagttttccattcacatggatatcactcagggaaattctcccataaggtatacaaatgtggaactaaccacctccctcatcctgaactaacaagaacagggtgtttctctacccattgttggcaaacatcttggaaaggctcagatagtaaatattttcagttttgcagctcatacagttcctgtggcaaggattcaactctgccaatacagtctgaaagtagccttatgtaaaaaagtagaagtggctgtttttatatttatttacaaaaggaggctgaaggccagatttggcccatgggtcttagtttgctgactcctacctgtaacacaacatgcctaagaagaaactaatcctaaaacttcttttgagagaattagtaattttatttatttatttaacttttattttagaatcagggggtacatgtgcaggtttgctacataagtatattgcctgatactgaggtttaggtttctaatgatcccatcatccaagtagtgaacatagtacctgataggtagttatttaacccttgcccccttcccttccttccccactttgaaatcccagtgtctattgttcccatctctgtgtccatgtgtacccaatgtttagctcctgcttataagtgaaaacagaacatgtggtatttggctttctgtttctgcgttaattcacttaggatgagggcctccagctgcatccatgttgctgcaaagggcgtgatttcattcatttttatggctgtgtagtgagaattagtaatttttaactaaggatgtagagtaaaatgatctagaaacttatctgtattttatttggcagttcagtgacttaaactatgtggagaggagttttagattttaaagaagcaatatgcagaggccaggcatggtggctcatgcctgtaatcccagcactttgggaagccaaagcaggcagatcacaatgtcaggagttggagactagcctggccaatatggtaaaaccccatctctactaaaaatacaaaaattagtcgggtgtggtggcacacacctgtagtcccagctacttgggaggctgaggcagaagaatcgcttgaaccatgcaggcggaggttacaatgagccgagattgtgccactgcactccagcctgggctacagagtgagaccctgtctcaaaaaaaaaaaaaaaaaaaaaaaaaaaaaaaaaaaaaagaagcagtatgcttggttgaacactaacaactgtaacccttccttctggcatcatttaataattttagtagggcagacaatgctggtcacttaatcaatgtccattccactctctctcctcacggacaaaacacatatttattttgagggatggccatatagctggctaaaaacctggatgtctcacatttcttacttaaatatcaatagcaagtgaagttcttctaacaagtcgtgtgagagtggaagtctactcaggttgacttccaaagctgttgtttttaaggcaaaaaaaaaaaaaaagagtcagcttttgctctgagcccttcttcctgccttcatggaatgcagttctgatgcttgacatttctcaggcatattgtgaccttgaggataaagccacatgtttaagttggaggaaactgaaaactgggagaagactgagctgtggactcccttgaggaggtgtaagtatcatggtgtgattgaatatagattcttggttaggagtaaaagaaaccttatttgattaagccactgaagccaagattctgatatgtatagctcaactcaatactatctttagatttaaaatagtgtctctattttatataagatgaacatgatctaaaattcaattttacaccagagtctaatttcattaatttcatgtttctcttcctgcttctattttaatagttattttttcaaagagagttctatttcagaagatttaggtaggaaattaaggaaattgcaaaaaccctttcactgtgctaaggtgctcttactttgcaggtatgttcaaactaaatacttctgtctgcaatattctcagcagcaggcatcgctgaccctaaactagagtataaaagagtgggaggatgaaacagaaattgaaaaagctcttaaaaatcaataaaatgttaggttgtacaagatattgaaatacaagacattgctcttaagaaaacagctagatagctaggtcagagtgcagtaggtcaagtcctttttatgaactgagcagggaggttgtgaccatgaaggagctgcacagcagggaaagattgctgcagagcaggtaacagcctgccaaataaagacggcttcatgtcaggaaccacacaatcttctgggagagcagaggtttgctaaaggattctcttaagatttttttttttttaatttttggggcctagtgcaaatgcatttctttcccacaagaagcatgactaattctcctgatctttacaaataaataaataaagattcccttaagaccttggtcttgtccacacgtgacttgaagcaatagaggtagaaatgaacctcacacacaaaaaaatccttactgattctcttaactctacattataatgcttggaagtatttctgacagtcagagatttgagaaatttatttgagtactttgttttaaaataacgaatacttttcaaatattaactgtaaggaatttaaaaggtagattatatactagactatagagaatatacgtaacattcaaacactctccacttcgtctcaaagaaatggtgataattttgaaatgctgctgcatgagaaagtgtctgaatttttctgttctggaatctttcctttttttttctcacattgaatttattctccatggtatagactgtgatggaatgccaaattatttcttctgaagccttattagtaaatattagtctaatcaaatatttagtcaagacataatcttccattactgaatttttatttgttcattacagaagtgctggatatttccaaacctgaacacactctctgtagatacttcatgggaattaatattattgcactatcacatgtatgttcttatcatgctatgaacatggcaattaaaagccctgtgactactactactaactcagttggaaaagcaattatccacttactcatcaccaaggcacttcttaggaatgcatttcagaacaataatcaatagagatatttatgttgatatagtattggttatattcatgtctgatataatatgggttacaatgacactacaaagtttaactttggatatgccatgggtagaaattaaataaaccttgtaattaaaaccagataaaagttcatgctttgtaccacagctgacttggatcttggccacaatagctaaaagatgaaaggatctcggtaatgcctcagaggtagtgggaaactagagctacccatttgccatttaagaatttctcagatgatcctgagccttgaaaaggaatggtgtggcttgcctggggcacataccttcaacaccttaccatatgccactccctcagccagggaggtgactctagtccactctgagttataaagaattttttctttcacgcaccacattttcagcttctcctaaaatctagaaatatcctcaaactaacattaaaccaacagcggtgtctgtaggcctggctgtatcgctccagaacattgggctcagccagttaaactctgacaagcaatctttatgtcctgattgtccaagcacaaatggctgaccatcagcaattaaacatagcatccagcaattcacattctagcacatgtcgaacgaatcctccaggaattatcataaccaatttaactcaacacttccaaggaagaggattaagatgtgcacaccagagtaatttcttctcactcattcttttagcttgcttgtggcacaattggtccttagagcaagagtcacatcagagaaagtatgcttggatgcatttattccagcaatgtcaggaaactcatcctggttagtagcccaaactgtagcttctaacatgggagatcttttaaaaatactttagcccatttcactatgtgtttgtattgcaaccagaacacataaaaaataatggcatgcagctgggtgctgtgatgcatgcctgtagtcccagctactaggaaggctgaagaaggaagattgcctgaggccagcctgggtaacatagcaacaccttatcaagaaaagaaaaaaaaaaaaagataatgacatgcaaagaggcagaaaataaagaaagtcccattttaatcatgagaattcatctgggaaatagtagactttttaatagaatttaattattttattttgattgtagtgttattcaaattacaacttatcctgttctagattattgttagtgatctgtaaatgtcttccaaatcatttgataaaaacactttctaacagtgagctactgcttgatttcagaacaggctggacttttgaatccacaaaatgacactgttataaatgtccaggattctgcataaactctgcttatttttccttactcttaggaagattagatagtctgttttcaagtcacagtcctttttctggtctctcatttggtgtggatcaagtcacttaaccttctatgtgtttgtttcttcatctttaaaattaggttaataattttgaccttttgccttggcgttttactctgaactaaagaaaaacattaacacatggaaattatcctgggatctgtagatgaaatgtgcagagatggaaggagttattctatttaaaagaaaaaattagacatacttcagtgaattcacttcacatgtgtgttctgcttcagtgaagttgaaagaaagtggttactggaatagacagatgtttacatgcatgtttggactggtaagcaatgatattgaaaatattactattcctaacacatagagacttactggcctgatcaatttgattcttcacttatttattcacagctgaattctgcttgcagtacacatgcaaagcattcttgctggcaggtaggggaataaagattttttagtttgtgtttttaaaatgaactcaagaagaaaattaaattccagatacttcataaatatatttttacaaatatgtttctataaattttagtttacctcttgctgagagaaaatcaaatgcattgtgaaaagtggagaggatatgtgaagaccaccttccctttcttttccttgacctctgcaactgtcctttattgcattgtttttgatctgggtagaggttatggaaggtaactactctccagaactatgaagcctatctgctttgtcgtttctctttaagtccctttaaaaaaatctaaagacatgaattagatgcttggacatgtcttttactttacatacctctatttccctatttccctctaggaaatataagaaatccagtttttcccccttctgtgattaatataaattttgtgtagtattaatacccaacagcacaattcaaaaaaaatttatcaaagaaaaccctgataacaaatcacattttaattcaaattttataattttactctaaagtgacatgaaatcttggatttatggaaattatagatgtttggattaaacacataaattatttaagacaagaaagaccatttcttacataaaattgaccatagacaactgacaaccttaaattcttaggctcaaatctaaagtgtggcaaggtagaagtatgcccaacatacttcctttttttcgacttctcctttgcaaaaaaactacacctaccagtcatactgtccagatgaaagccactcagtctgctttcaataagaacatgaattaaatactctcaatggaatcccactgctggttgagtcaagcattctttgcacatcctgcttcacaaagttccacaaaatctgaccattccttatattttaacatgattataattcatacatactgagcatttgctacatatcaggtgctatgcaaacgatttacttttccaaacttaaataataatcccaagaattccacaaggtagacactgatagtttgctaagttacaaatgtgtaactaaatctagagaaaactgagtaactttgcaagaggctcaaggttagtaagtgacagaaacaaaatataaactcggatctgcctgatttgggatggttttcttaatacttacactgtcttgtctcctgtccaaataactctggaaattgttttattctccctgttgttagttgctactctctgtcttcctcacttccacttccagaaaacttcaagctcttaactgctctaacctgttcaccaagttcctactggtgaacaggtgtgtattagtccatcttgcattgctataaagaaatacctgaggctggataatttataaagaaaagaggtttaattggcttacagttctgcagactgcacaggaagtatgatgctggcatctgcttggcttctggggcagcctcaggaaacttacaatcattgtggaagacgaatggggagcaggcatgtcacatggtgagagcgagagcaaggcggggcggaggtgctacacacttttatacaatcatgtctcatgagaactcactcactatgatgaggacagcaccaagttgatggttctaagccattcatgaggaactgcccccatgatgcagtcacttcacacgaggccgcagctccaccactggggattataattcaacataagatttgggttgacatagatccaaaccatatcaaggtaagcaagtgattattgttctagtagtttttgaaaaagtttataaatgattatctataaattatacctctgcatttgattacagatgctaagtagtttaggaatctgaagttagtaagcttttctttttaaaatattgatacatccaagaagagaagataataattaaatatagcattgttttagttttgtgcttattatatattgttgatttttatattatatacattgattttattgattttagcagaaaatttagctctgatggagttttgtcatcttgatggtgaaaacagtctcatcatccttttaaatgagtcactgctaaaaaagtatctgaatagacacatggctctaaatacacacacacacaaacacacacacacacacaagctgatcatgtcaagttatttaaagtcagaagacttaccaattgatcctgcgctggcagaattttatcagtttggggaactaactggggcctgatcatcactggtaaaaatatgtgctatataatgataatttctttgtcttgtgaaaacactaaaattcctaggagaactggctaactcatatttattgtctgcattgtaggaattatgtagaaccagaaaataagaaatacctctgtacaattgtgtgtgtgtgtctgtgtatgcatgtgggtatcaccaaaaaatattaaaatattttccaaacaaaactaagcatgtgacttaatattaattctgttggtcttcatgcccattaagatgttcttaatcagtggatctctgtgttacaaaggtggttctggataggggttagcaagattaatatgttgaagggaaatataaaaatgaagctgtgttcttcctaacattatgaggaagcatacttgaaccctaataaaattctaaaagaattttcctcttttcagtttccctaaatgtactgctatctctgaccctcatcatcctggcatttaagtcacaatgctgacaaaatctaatcaggaaatggcaacctataaattttgtggaccaatgtaaaagggctccctttatcataatatgataatatcataatatcaaatatacccggggtccccaacccttgggccacaggcaagtacacacttttttggggagattgcaaaaataaagggaaaagccacaaacgcagaaaaaggaagggaaattaagatatgtaagctgagtcttccacttaggttatggaaaatcacaacaaaagatcacctctcatcacagcaagaacatgctagatgttctacaaaacctaaattttgtaaagaccatcagaaagctgaggttgtaatgtaaactaatgaaatgaaaggctaatgatggactagttgagaagaaatccttccacaggcaagtctgcactcatccacacaacccactcttttatgtggtctttacttaaaagagagctcatgaagattctgagcagcacggaggcatgaaaaagaccctttgtactgcaaacaggagaagtctgcctaagtttgagtgtgaaacaggaaaaacaaggaaaaccctcccacattctggattctgcatgagtttaaaggcaaagatcttttgtcacttaaagaggggccagcaaacactccctttactttcagcctagcagcaagtacagagaaatgttatctacaatggagggaggtcaggactattgagaaagcccaaccccagggcataggtatacagagactaagactaaggctgaaacaagagagccaaaagaagtcttcttatgatttagattctgcctgagagtgaggtaggaggtcattagccacagtgggagggacaagaattctatttgtattccagaacttgtacagagaagaagacaaaggttttctcctgcctatactcttgattataggttgaaccatgaggcagaagtcatctgttactaagtgaaggggtggaaaacatgcacatggtgtaaagtctgcaatgactaggaagaagtgtatgcttctgggaaaagagcagaaaaattgagagtgatttcctctggggtgtaggtgcagggtgagcctgcacccaatatgactaaatgcgaagcaaagaactggactaagtgagggctactgccaatgagcagttaactagagcttttctatgagagagaatatcaagtaaggaggaatattctaagacaaagcacctggctaagaagctggaaaagacagatggagtgataaagaaacggatgcattttgcaaagagcagctggctagagtagaggaaaggaactcagagttctgcaaggtcaccactcaacataattagaaagctgctgaagaggtggcaggaaagttcaagtgcataagtctcatccagtctttactgatccatatgccacaattctccagtattatcaccagaacaacccaaaactctcagctgctctgctctggccaaccagtatagacagagcatgcttgtgaagggaagataaaatgaacttttagagcatgcaaaatttcttcaacattaattcaagggatgcaacatattttttttcctagtaagaaaataacctatttgaagagaagagcatcaaaaagtattatgtagcagattcaacagaattatattacatcttaatcagcaacagtttaaaaagccaaggcctagatcagggatcagtcatcaaagaacactcttcaatattaataaacctcatttatggtgattaaaagagaaggacagctctctccacatttttgtatttttaacttaacttctactgattataaattatttctcttgtaattcagctccatcattcggtgaacctacattctagcaaatttggagtttgggtggcaggggctaataggaatggaaagaggaggaggcaaacaatcttggggcaacagtgctatgtggaattgtctagactgtggcatgttgattttctctcttttgcttttttcctttgattacttaagagctatctcattttaacttctaatagtgatcatgcaaacaaaaagacaaaaaggagaaaagatgtacctttttactggaatagtatttatgattaaaagtcaaacaaggcatttttgtcaatataaaggcaattttagccaggcacaatggcttacacctataatcccagcactttgagaggtcaaggtgggcagatcacctgaggtcaggagtttgagaccagactggccaacatggcgaaaccctgtgtctactgaaaatacaaaaattaaccgcgtgtggtggcgagcacctgtaatcccagctacctgggagactgaggcaggagaattgcttgaactcggaggcagaggttgcagtgacctgagatggtgccactgcattccagcctgggtgacagagcaagactccattgctgagaccagctcattcggagagactctaacccagcggcgctagaggaattaaagacacacgcacagaaatatagaggtgtgaagtgggaaatcaggggtctcacagccttcagagctgacagccccgaacagagatttacccacatatttattaacagcaaaccagtcattagcattgtttctatagatattaaattaactataagtattccttaagggaaacgaagggatgggccgacttaattgaagcaggaacacgcccttaagacacagatcgctcatgctaattgtctgtggcttaagaatgcctttaagtggttttccgccctgggcaggccaggtgttccttgccctcgttcctgtaaacccacaaccttccagcttgggcattagggccattatggacaggctatagtgctgcagagattttatttatggccagtcttggggccagtttatggccagatttgggggggcttgctcccaacactccatctcaaaaataaataattaattaattaattttaaaaaattaagggaattttggcttacacaacttctcctttaccataaatactgttatattcacgccattcactatcaataataaatgttttgtgatgaatattggcattgtaaaaccaaaaactcaaaaaccctcatccaaaaactttatgggcaactgaaaacccctcccatacatggaactgcacagagtaccaagaggcagctgtctgccgctggtagacaagagcactgagaaagatatagctctactcctgtgtccaagtcacaggtgcacagagcctgtttacgcgtgaaaacatacacattgaaacaaaacttcacacaaacacatactctaggacttttagcaagtactacacagtagcaatgtacttctgagatagaagaatactgatagaaagtacttctgtgatgcacgcacacagggccagctgaagtattagtgtagagaactaatgataaggtagtgtctatatgcaaatcaggtacttgaaggctgtggacactgatcttaaataaagcaacaaagaccaaatgcagctcaactagagattgagttagcccaacactcgtacttgagggctcacagaaaaagaagcatgtctgtttctgggtataaatattatatgcattaatctgtactgttcatctacaaacaatgttcagtatttaatttaaaaattatttggcacatataagtcaagaacatattgctcatcatcaagaggtataatagtcaatacaactagattcagaaatggggtggggggctaggggagggatagcattaggggaaatacctaatgtaggtgatgggttgatgggtgcagcaaaccaccatggcatgtgtatatctatgtaacaaaactacacattctgcacatgtaccccagaacttaaaatataaataaatgaataaataaaaacaaatagcctacatgttagaattatcagaaactttaacaaataataatatattaaaggatttagtggaaaaagtaatgatatacaacaaaaatgaaaaatttttaaagtactataaaaaagaataaataaaaatgctagaaactaaaaacatggtatcaaagataaagaatttttctgatagtcttatctgctgactagatataggagaggaaataatcaatgaacttgaatccatgcttataacctaactaaataaaaacacacacaaaaaaacagtgccaaataactgtaatggagcacttgtgatatttagcacagtataaaatcatttagcatatacactattggagtgcaagaaggataagagagcatgaggtagaaaaaaatggaaaagatactatttgaggatttaccaaaattaataaaagatacaaaactacagattccagaagctcagagtatccctaaaaggacagatataatgaaaaacatgccaaggtacaccatagtcaaacttataaaaaataaagagaaaatctttaatccaaccaaggggataaaaaagaaactttacatacaagaaagcaataataagaagatagcagacattttagaaaaagcatgcaactaaatgatgtttttaaagtgcttcaattaaaaaagaaactagaaatacatatccaaaaaatatgtttcctaaaaagtaggtaagatgaagaactcatacaaaaatgtataaataaaacaagacagagtaaatatgttaggaaatacaaaagttcctttaaaagtattcttaacatatgatttttgaatgcatcaagtaaaataataagaaatagtttaccatgtatactgaaatgaagtatatgacaccaaaacatgacatattgaagagtattagttgaaaatatacattaatattattttaaatggatcatattatagaattttaacataaactgtaataaatttatgatgcggccaggcacgttggctcacgcctgtaatcccagcactttgggaggctgaggcgggcggatcacgaggtcaggagatcgagactgtcctggctaacaagatgaaaccccgtctctactaaaaatacaaaaattagccaggcgtggtggcaggtgcctgtagtcccagctactcaggaggctgagacaggagaatggcatgaacccgagaggtggagctttcagtgagctgagattgcaccactgtactccagcttgggcaacagagcgagaccccatctcaaaaaataataataataataattttatgttacatattttaatgtctagtgcaactatgaaagtgacataggtagacgtaactaaataatcaatagaaaagataaaacagaattctacaaatgttagatctactaaaaagcatatagaaaaaagagaaaagagagaaaagagcagattcaccaagtatacagatggtattttaagtatacagatggtatacagaaatacaaacattgaaataattacattaaaggtaaataaatacctaaattaaaaggaaaaaaatcctgaatgaataaaaacacaagatccaaataaatggcttttaaaataaatacattttaaagacacaatctgttttaaattaaatgaataaaaaatgatataccataccaacactaagtaatagaaaagagatatgacagtactaatatcagacaaagtagacttcaaaggaaagagtattttgagatgaaaagtgggatatttcatagttataaaaagttaactaaataacaagatatagcaattctaaattcctgaatatgtatgcatctgatgcgaaagttctcaaaaacacgtagtaaagattgatggaaacaaagggaactatggaccaatcacaaaatgtaagtgcagaattttatatcttttcactagtaattgataaaacaagtaggcacaaatttccgtaaggtaatacatgatttaagcaaaactgttaaccgcttgacataatgatatttatagaacttgaaatacagcaaacagaataaatattttctgctttcaagtgcacatggtatatttgccaagatagaccataggctgagtcagtataaacgtttctacaactatcttaaaaacatttatgaaactgtccaagacctgacatcatgcagaatatgttctctgaccaaaattgtattaaaatagaaattagtaacaataagatatccagaaaatgtgtgaatatttagatgttattgaaagcatactactaaataatatctggttcctttaaaatattaataaaattaataatcactagaaagactggtgaataatatagaatacacagattgccaatatcaggtttaaatgaggtaacattgcattagatgcttcaaatatcaaaagaataaaaagaaaatttttggaacaatgttttgacaattaaaaagctaatttaaataaaatgtgaaacaatcttgaaagaaacacattaccaaaactcactcagaaaagaataaaaaatctattttgtcttatatatcttgcataaactgaattcatgatttaacaagttccgacaacaaccagaaaaaatactccaggaaaacatggcttcagtggtgactctagtattttaggaatatgtaatattaattgtatgcacagtcttttagaaaatagaggataaaacattctctaactcattttatgaggccattattaccatggtatttgttatagaccataagtttatgttccctcaaaccccaatataatagtattatgaagtaagtagactctttgggaggtgattggacatgagggcgtagccttcgtgagtgggattagtgcccttacaaataagacaagagagcttgcctcttctctctggcctaggccatgtgaggatataacaaaaagatgtccatctgcaaaccaggaagaatttcataactagacactggatctgtctgcaggcaacttgatcttgaacttcccagctttcagaactgttagaaataaatgtttgttagctaagccacccagtctgtggtattctattatagcaaactgaattgactaaaaccacactagaatgacacaagaactttgaaagataatacagaccaatatcacacatgaacatagatgcaaagttcataatgaatgttagcaaatcaaattcatcaatatttcaaaatgttaatataaaaaccaagcaatatttatcctatgaatgtgaagtttaacacaataaaatgcatagaagttattcactacataaagggaaattaataatgtgatccttttaatagatgcaaaaatgtatttaataatataacacacttgtatcataattatgttgcttagttttctttactatatggccatctacctttatcattaaaggataagaatgcaaggtattgttctaatcttacctatgttacctctttgtttattacctagactgtaaggtaataaagcagattcactctttaccacccgctttgcacaataccctatttgttttcccattattgtgtgtaaatgtgtaaagtagcatttttttctgaaatatgtatgccatgtgctgtctgttctcaataagagctgattcattacacaccctcaaagaacattttccttccaaatggattatgttctctttaaatggaggaaggttactgacaatcattgtatgtgccatggctgaagtaaatgagttcttgtcagaacaaggggagaaaaatagaaatttgggctaagccaaaacatgaggctggcaaaatttggcctctggattcttagaagtcctccccatctgtccagtgattgatagtcctcttttcatcatacaaagacacttttggaagggtcttttataagagatacaatcactttggtgtaacgttttccgtaagtattggatttgcaattagtattttgttgatgtttaatagcaagacgttgaaatattctataataattgtccattttttcctccatgcagtgggtatccattttcactttgtgtattttaatgctccatcatcattatgaagaaacctttcttattcctggtaaaatatctttgctctgagatctaatctgtcttacagtgatatggcccccctagctttcttttgacaagtgttgacataatatgtgttcttacattcttttcttttgactcattttgtcctcatttttaaaaaagcttgtttgtgtagtcaacagagttgacctcacgcttttatccaaatgaatactctctgtcttttaattttggtgtttagaccatttacatttaatatattattattatgtttaaattttatttattatcttgttatttattttataattgtccagtctaccttaccttcttacttttttttttttttttttgcattttcttgcactgagtacatttaatgattttcttttatctcctttgttgtcctcctggctaaaacactttatcattttaatggctgctgtagagttcatagtatatttttctttaacttacagaccagtttcaactgctattacatcctgataatatttgattggatacaaaatattaatttttctcatttctgttggctatttttttttgtattgcaatacatatcccagtgtttggtactatgattcagctagttatgtggagtcagttttatacttttatttcctgcttttatgatttttttaaagcaactccaaagtagtgctgaatctatgactaattatcctctactgatgcatgacttttctgaattatctattcaatatcctgtcatttttttccagttttgttagtgaaaacagccactattcctggctttatatgaatgctagacactgtttttcttaaactgtttcagatgatttttttttcctaaactggaacagtttcctcacagagatgcattgttcagtacactgaaaacttgcagcagatctctgggtttttttttctctacttaaacttgagcactcagcactgactaaaccaaatttgtggctagatgtctttaaacaaaatctcttcttccagttttctgtgttccttaaaaacattttaactttgcaaacttcctaaacacaattaatcttttaactattcctgtatatttccaaagcacattgtgtacacccttattaagaaactcaacactatcttacagaagtgtaagcacttgtctgtcttccttgaagggaaaaaaaaattgatttgttgatttgtacatttttacacttcatagtaagaataataaggattaacatagtagcaattaacaatatttgttgttagataaacaatacagaattctcaatcatttctgtaactcaaaaataaaagtatagtcctggaatctagaaggctaataaaagaaacagaggtaccccaaattttcaaacaggattccaaaaatgagtcaagtgtcaattgttgtgagtaaatgaatcaatttccttctctttattatacaagttttgtgtgctggtaatacctaatattaaataagtataatatggggtatttatattcagtactaacagagtattaaaaaaaccctctcctttttttccaaaatagcaattttctctctctgacacagttgtactatagtttatgtttgttcttaaatcatttaggacaatttccaaaaggtctttgcttgtaagacaaggcttcactctaagaaataggctttcaagtacatagggtccgaggaagtgagtagcagggtacgtagcaataaggattttataagcctttcttcctgtcttctgaccaaggctatccacgctttaatgctcagatcatctgttgtttataatttccagagaactattgatcttttttttctgataacatatagagcataattatatttcttgaaattttctatttttagaaggatttgaattatttgtcaaaaattgaattcaggttgagtccactgttctccctgtagctgtttctaattccgtgaggttcttgttctttgtgctgagaatattctctctttgaaagaccgatctgccttcttcttcaaatccttagcttagatgtagttatctcaccactgtctaccatgagcatgtttcatttaaagaatgaagctaatgaaaggttttggcccttgctctgcaagtgagtaacagtcggctccagtattattacgtcacatgataactatgtagttttctccatacctgggaaacatctcttatacttgatatgggaagtgaaaataatttcaacagatacagattttagactgtttaaaatcactttgtatgagttaagaggataatctttaaatacacttccaattcaggattaagccccaaacttcaagaggttcatttgattttggctgtttctcagttcattcaatatcattagctgtgcttagtggcagattcttaagaagaggtcttacttgcatgtaagtcaattgttttagagaaaatattaattaaaataagtggtgagtgaatttaaatcaagcagggccatgcctctattctgagtttaaatccctgactcatttttttctgtcttcctggatacaatatagaaatatgtatttgataaatatctccatccagaaaaatgaattcaaaatcacatttagagctttgaaccaaatctttcacagtaacagatgctctttcctgaaacaagcttattccacccagtgtatttaatagcatcacttttacaagtgaggggcaggtgggtggaagaacatgcatctcataacctgcctcccttcatactcattcatatattgcatgtttttcccatttgtgtttttataagcacacagattattatacttgcatagccagggtgataccagcgaggcctggggcccagctttgcagtgactgtgacaagcttggaaaaataacctggttgacaacacatttatctgctaaatgtgtcttggagcagagaatagcaacaatggagaagatacttttactctttctgcccagaaagtcacctctgcacttaggataaagaataataaggagccttgtggatggaaaagaatatattatttatttatagtacctttttggtttttcttctttttcaagagactgaaagaattaaagcaacgggaatttgctcgaaatgtagcttctaagtcatggaaagatgagaaaaaacaagaaaaagcacttaaacgacttcatcagctggctgagttaaggcagcaatctgaatggtaagaattaaaggtgtctgggatgcttcaaaactctcgtcaacctatggggaaattttaaaggcaaatctactgtaacaatgtaaacaaataataactaactaatagatatgtctgaagggcaaatatagttaaacatacataaattaataacttttggcctttgatatttttctttcctaatattgttaatttaatgtactctataatgaaatgatcccagaatgattcaaatacattagcatttattctatccagttgactaaatggattaatatcacttcttaatatattttttaaattttgtaataataattttaaaaaccataattaacaatatatcttagggggtggggaataagtcttctgaacatttccgtgtacacacctgtgtctagtacaaataacacgatcattgtctggctgacaaacaagatgtaattaatgcagttaaatttaccacacagtgccatttaaattgataattataatataacaagttttatactaatacattcttgtagctgaaaaatagcagttttaccaaagcttggaaccactggatgtttcaaagttgttacctggaatgcaattaaatttgtggattgtgatttgtgttcatatgaatcataatgtaaaacactaatgtagctaattaatgtgtttgacagcaacctagtgaattgtgaaacttatgcctctgtgccagaatttaaacacctattgcttaaatggaaagtaatatataataaacaggagtgagtggctcaattagttaccacaaaatattagacttaaaaggtaattttaaggaaacatttatttttgtaggaccaattatgagtaaaaatgcaattaatattcagcttgcatgtatttatttataacttttagaataatctaattaatttatgaaaatacataaaagataatcatattaacaagaaatgagaaatttcatatgaagacaaaataaaggtacaacatgtagccagaagtaaggttaatacaaaaatgcatgctctggggtcttatacaactctagaagcaacgcatacatttggtactgagctttctacagccaacacaatgagggacttacaatatgttgtgcaaacatactgttaatgagaactcagtccttgccaaaatagggcttagaaggaaaagttctattgttgttagggtagcatgcaggaaaaaatctagggaaagtgttaattcctgtgattaataaggagatgcagtaagtcagatcataacaaatggtacaagttctaacatagatatacgtctttagacaggtcccttaagggcacaacagtaaatctaaatagtcttaacaaatataattttggttgtttgttattatgaaagttgtcacacttctacatttctgcttacccattctatattttcctctggagtaaataacaaagaatcagaggtgccttgctgatggcagtggtcatggtgatggtgatgatgataatgatgctgatgatgataatgatgctgatgatgataatgatggtgatgatgatggtttatttagaagttccaagtttgctagagctacccattaagtttctttcaaataaaaaggtccactctattaagtttcagctgtccctctggaagccttattcactaaacaaacacaaacctaaccactccttttggtgatttgataaaataggcaaactctctaggtcacaatgtgcccgtattgttatggaaaagacaagtgttcagctttctagatatagagcctgaaactaggaaaataatttttttttatcgtctactgcccatcacctgcctcttagccaattgctctctctgcttaaacagactcatggttgaaggaaagtcacttaacagaattattaaatactttattttagtaggtgaattgacaagtgaaagttaaaaataaaataaaaagaaaaaatcactggcattacccttctcctggacaatcttttctttgtcctttttcctcataatgagggcttctgaataggatgatccaggtaacacaattcttctgtgaccctttgggagaagagaggtgaatttactggtagtgcataaaatgatggcaaaaaaatggtaacagatcttataaagggtcatcaaatttgaccgtctcttaactagttccagccaacctgtttcctcagcaatagcagttattatatggggctgagggtttagtccctctctgtatgtgaacttcttatgtatgtaagttttagtacatcttaatatggaaatttttccaaaatttaaaaattttagggccactgattctgagactatgaattttttaagtggtgtcatttcttaatgttccacgttatctagctcttatatgaagtttttcatataagagctggaaaatggaacacgaaagaatgacaccattttaaaaaatcatgttgttttgatatgtttttctttctgtttggtaaggatgctttttgaacaggagagaatcaaaatgtgcatttgttaagctgcagagtattagaatttttggagaacaatttgaatggaaaatccatcaataagaattaaaaaccaaactctacagacactttattaaccattattttaatataagtaagaatatattttcaaaactaaagaaagttccaaagaagtgagggaaatattaaatgtggagaaaactataaaaattgaagtttcattgagaatgcaactgtggtttcaaggggcgggctggtgggagaaatgtgaaggtattgttcaaagtttataaactttccgatgtaagatgaataagttttgaggatctaatgtagagcatgattatcttagctaataataccgtattgtttacttgaaatttgccaagagagtgaatctagtgcccttatctcacacaaaatggtaactacgtgtatgatagatgcacaaattaatttgtttgcatacatcaaatgatcacattgtataccttgaatatatacaatttttttccagttatatctcaataaacctagaaaaagttaaagctttaataatgttataatacccaaacttgtattaaaatagtagaatttaaaaccccacaaagataaaaacaggattttccaaaataataagaataactttgatttaagaaaaagcaaattaaaatttataaagcaacaagataaaaagtttaaagaataaaagtaagaagtgtcaaagattaacaataaggacaaaatgttaaaacttgtgaaaaatctgtaattataaatgcagtttaaattggaaaatgagaactagaattaaggacaagaagctagagaacattgtattagaaaaacaataagagcaaagaaattttaaaatatttaaaagaatgtaaaaagaagaagcttgcatattagagagctacatggtaaaataaaacagcagtacagaaaagaacatttagattaacataaagcaagaaaatgaataaaacagtgtcaggataatcagcaaaattattattaagaaaagtatatatataatatatttaacatgatataataaatactaaaataactgcataataatggaattgggaaaggaagaacaatagtatccatacactagacttgtggaataatttcaactgtgtttcatacaggtgataatgtcagatcgattgaagcttctggagaagattaacttaatccagaagtatagttcctacttaatccaaattgtggctacaaatatggaaaataatctctttggtaccaaggcaaagttgaatgctgcagctgtttctggatcacttccttctatctgcaggctggaggcactttcaaaggccaataatgttgtaataaagtctctacgctccttatttacttttatgcttgaaagaaacattcagtaactcatatactatcttagaatgctcctcactattcattttattaaatatgcctaatgaacatcaaaaatttactcaataaaaggagattaatgtgatgaataagaactttccgttatgaaagagttactgtaaggaagataatacagcttttaaaaacgtctaaatttagttttttacaagatttaaaggaactctgtaattctaaaattacagccattcatgaagaggagacgttctaaaatcattaaaagctaaatggtggctaaaattagtgtttgcaagttaaaatccatatggtcataatttgtaaacagattgaatattgtaaaaaaaactgagtcagtaaaatagaaataaaatcaaagaaattctccctgaactatagaaaaagactgaagacagaataaagtactgagataaatatcaatacctaaaggatatattcaggagagccaatgattttaaaacataaattccaaaggaagcaataatcagataaatcaagggaaaaaaatgtatctgaactgaagaaagttaaattgaaagtgcccaagaacaaaaattcacccaaattaatcaaccttaactatgttctattaaaatgttatacatacatatatgtatatattaatatacatgtatatatactctttatgtaacaaatctaatgaattatatatatttatatttttacactttataagaagggaaaagcatacaagcacacaagcagattcatctcaaagataaataaagggaagctaattcaatatgtctataatatgattcatctagagacaatgaagcaaagtacatgaaatttggtggacaaaaggaatgtgatgactctagagttcgatgctgatttgccaaagaatggtaaaagaaaccaacaagaatttgttagacaaggactcagaaagcactactctacattagaacttgagcaacatatggaagagataccagttggcttagtattttatattcaagcaacaaatgactagaggaaagtaaaataaaaatcaaaattagaaataagcaaacaaacacatccaagtatatggaacaagaaaaagaatgccagttcaaagcaaacaataagaaaaatgatgtgatttgtattgtcttctttccagtgaagccttcttttatagtagagggtatatagatagactgttaaagggcatataattttaatctaaagaattttatctcttatatatgttgatattttcaatcttctgtatgaattgctaatgaagctcagtagaacaaataaccttttgagacctttaaaagataaaacatataatgcagaaatggtagaaaaaatattttggtgagtaagaagcagaagaaaagatttcaaaatcattgaaggtatttagatagattgtacatatgtcttattttattatgcatttattataattagtcaaattactgacaagtcataaagaaagaacttaccactgtgtttcaaaagtaagtgaatatgagggaattttaaacccaaggagctaaacattataaaatgttagaaatagcacataaaagcaaatttaaaaaaatttttatatttttaaagtggcttttaattctatttaatttcttatttaatgtgaatgcactgattggaaaactattagtgaaatcatgttaaatctgtattccaaagattgatagattctataggacatatattgtgatgtaaatgctttagaagcagtagcataagataattcacttgctattgctttttggtaattgcaaaatactacatgtaaacaattcattttagaaatagccactatacaatttatgctaagctatataaggacaacaaaaggttatgttttagaagatgtagctcataaaatgtaaaataactcatcttagaaacactatgaaatgttcatatgtagatatgattccaaagctaatctcttaatcatttaaatatttattgtatttacagtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaa

SEQ ID NO: 526 - DNA, 887042 bp, Homo sapiens
ctgacaaggagtccatcctgaccatcctcaaggtcctcggagatctgctttctgttggtgagtaggccatgctctcatgctttcatatggcggatgtggagcctgctggctgtgatctctcccaggcacctctgtgacctgggggtttgctcttgcttcagtttcctgtgagaggcagcatcactagcccatcttttttctctaaggttaataagacccaagtaacctggactgtttgtacttgcactcctcagtcttctcacccgacactgaggaggaaattagatttagtagtaaccctccgtggttctacccctcttctcgccctgctcgcttccattgtgacctatttaagagagctgagtatcagaagctgctttggctatttgaagtagaggcaggaatatcaggcagaagctgaacttgaaagcatgtaagcatcacgttttcagagataagataacagagttgactacattggaatcaactggattaactggagcatgcttctattcgctcaagttcttactgagatttttgaacattccaacattcactcaatttgcatttttatgtatgcttgcctcattactttagaaagaaatattaacactgaacaggcaatatcagaaataaatgacactccagacccatagatcctcaggattatggtttcaagaggaaggggcccattgtattggggtctttccatggtttgtgctgcgttccactggcaggatgacttacatttagtctttcacgtggggcctgtgtaagtgaagtcactcgtcttctgggatagtgctgtcttacatttgtccagaggtgtctgaaactcttaagacaaaaccttgaagttctccctctgataaggtggtgattactttgcctcttgcagagaatgctacttttcattaggacaaaaaatcagatggtcgtctttgataatgtaccaccctgttggccaccttggttaagtcaactttgccccgtacatagagagaatcaaccaaggccaagttgtaatgaaatcgttgcttttgagtttgtccttgggcaaggtggaggaggtccctgttcaaaattgtacttaggtagaaagaccaatagttcgtcatagctctagactgtcttcaaaattccctagataggatgattggatgtttctttctcaagggactactgcagtggtttctgtaattttcttccatcaatttctgaaggctagcatcagaaaatcattatgccatcaatacaatgattccagattaggccatcatcccaatccttgttacagaagattcaaatgtatagcagagggatactgatattctctcttctaagtatatgattattcaaaagcccatatgcatatttacatacatgtacacacatgtatacatacatatactgaatattcaacagaatctcagataagctctatttattacagctgttgcagctgaacacaactaggttcttaaatattccactattttcctatttcacaaccctcttcccttaactgatagtacaactttaacacaggttgcttcaagaactacataattttacgtagttgaaatgaactaattcttgctctgtctctagttgggaggtctgtcttctgctccaaggaaaatggggattattacttgtggctcatctttcctccggtttcccctcaggcacagaccggagaattcactacatgatcagcaagggtggcagtgaagctcttctgcagaccctggtagacacagcgaggacagctcctccagactatgacatcctcctgcctctcttccggctgctggccaaagttggcctaagaggtactcgtactccaagacctaaagctgactgaaaaggcacttctagggttgttatcatgagtgcaatttgggaagctttggtggagtagcacagggagaaagcgtcagggaggttctggacaacttgatggtgatggcaggaccagccccataggagaggccattttgttgactttgatgtcagctcatccaaggtatggtgctcaggacagagcccagaacaaacatgggctacatggggcatggataatatgggggaaaggaggggagatactccaatgcagtttttaattattttaaaaataaatggaacatgtctaaaagttgcatcacaaggttgtggagaaaaaggaacacttatacactgttggtgggagtataagttagttccaccattgtggaaaacagtgtggtgattcctcaaagacctaaagacagaaataccattcgatccagcaatcccgttactgggtatatacccaaaggaatagaaataattctattataaagacacctgcatgcatttgttcattgcagcactattcataattacaaagacacggactcaacctaaacgcccatctagactggataaagaaaatgtggtacacatacaccatggaatactatacagccataaaaaagaatgagatcatgtcctttgcagggacatgggtggagctggaggccattatccttagcaaactaaagcagaaacagaaaaccaaatacctcatgctgtcacttacaagtgggagctaaatgatgagaacatatggacacacagaggggaacaacacacacttgggcctgtcagaggatggagggtaagaggagggagaggcttagaaaaaataactaattggtactaggcttaatacctggatgctgaaataatctgtacaacaaacccccatgacacaagtttacctatgtaacaaacctgcacatttacccttgaacttaaaataaaagttaaaaaaataaagtctataatataagtgtcctagtttcctagagctgccatacgaattgccacaaactgtttagcttaacgtaacagaagactgttaggaggtcagaagtccaaaatcaaggtgttggcagggttggttccttctggagtctctgagggagaatcggttccatgcccctctcctctgagggttgccagaaatccttggtgtttcttggactatagatgcatcactctgatctctgcctccatcttcacgtgctgttctcctctgtatcatttcctctttgtgtaaggacatcagtcataggatttagggcccactctaatttgtaataaaatctgcaaagattctgtttcccaaaagaataacattctgagcttctgggtggacatgaatttttgggggccactattcaatccactacaagtcacacagaagtggaacattcctagttgaagggaagatggaagaagggcctagagttctttccatttaggctccatagtcatttctctttcaccaaggaaaaccctgaaacatttccctaaaactctagaagttcttggagcacagtttaaaagcatgggcactcaggactcatgcagacattgcaaacgagtcacaagtgttaagttctaattgtgtgctgagtcttatataggtcacagctgagaagctcagatcctctgaaaagtgggcctttgatgtccagtgctatcagtggcagccaaatgcccagggggtctggagcactcttccttccaatatttggatctccacgctgagtccattcaacatgctgctgataatgatggagaactaggcttttgccaacacctgcatgagcgtgtcccagaaaaaatcaatacaattcgtttggtgaatattcaacagatatttactgcatgtctcctagggccaggtgctttaggcactaggaacaccatgatgaccaaggcagttaaggacctgctctcatggaacttatgttcaagtggagaaggccagcaaatcaacaaataacttgatgatagcagactatgatgagggctgtaagaggaagcaagagtgatgctactttagactggcatggtcaggagaggtgacattggagctaaaacttgaagaatgagaagtcagtaaagcaaagagtgagccaggtggactccaggaaaggaccacagagacttgatatatacctcggtcataaacggtataagctggagagtcagacatgggtttcaggcctggccctgacacttattagctgtgtgaccttgggcaaagtacttaaactttctgagctttgtgcccttatgtataaaatagagctatctgtatagttggtcttccatttctgtgggttctgcacccatggattcagttaaccttggattgaaaatatttttaaaaattttatctgtactaaacatgtacaaacttttttcttgtcattattccctaagcaatacagtttaacaatgatttacatagcatttacattagattaagtattatagtaatctagagatgatgtaaggtctgaggatgtgtgtagattatatgcaaatactacaccattttatatcagggacttgagcatctgtggattttggaatctgtgggaatcctggaaccaatcccacgtggacactgagggatgactctacttaattccagggtgctgtgaggattaaacaaagtattgcatgtcacatgcttatcatatgttcagtgccctggcaaactagggtcatacaggttttataggagaaagagagagatgagagatacaccaggccagtgatttccaagttattcaccttgatattactattgtagtgattacatcaccacagtttctgccatcaaggggttatagtccttgacactgacattcaagttgccatgggctgacctgaacagaacagaaatgaggttggctgctcatgaaggaatgggatagatatctcttttctgatgaagggaatgggttatgtaggtttagttacaacctctttgctggtgtcctttagtccagaggtacatatcagtaaacgaggtttaggattttatttctgttttactcatttctacctccgataaatctgatagtgatgtattcttgcaaaaagaaacaggatgatttagacatcacccattgacaggtatcatagtgggggcaaagaacagaaaataagtatttcttttttaatgcttattttctaattattaaaataatgaggactatttgtaacactagctgtcaggttatttggaacagtaatgtagaaatattagaggggaaatagggggcattccaagatggcccaataggaacagctccggtctgcagcaactagcgtgactgacgcagaagatgggtgattactgcatttccaactgaggtaccgggttcatctcactggtgctggttggatagtgggtgcagcccatggagggcaagctgaagcagggcagggcgtcgcctcacctgagaagaacaagaggttgggggatttccctgtcctaggtgagggaagccctgacagactacctggaaaaatgggggcactctcacttaaatactgcacttttcccaaggttagcaacctgcagacaatgtaattctctcctgtgcctggcttggcaggtcccacacccacggagccttgctcactgctagcacagcagtctgacatcaatctgtgaggcagcagcctggctgggggaagggtgtccgccattgctgaggcctgactaggtaaacaaagccgggaagctccaactgggtagagcccaccatagctcttcaaggcctactgcctctagactccacttctatcggcaaggcatagctgaacaaaaggcagcaaacaacttctgcagacttaaacatccctgtctgacaactctgaagagagcaatggttctcccagcacagtgtttgagctctgagaacagacagactgcctcctcaagtgtgtccctgacccccatgtagcctaactgggagacacctcccagtaggggccgactgacacctcatgtaggcagctgcccctctggaatgaagcttccagaggaaggatcaggcagcaatatttgctgttctgcagtatttgctgttctgcagcctctgctggtgatacccaggcaaacaaggtctggagtggaactccagcaaactccaacagacctgcagttgagggacctgactgtcaggaggaaagctaacaaacagaaaggaatagcattgatatcaacaaagatcatctacaccaaaacctcatctgtagatcaccaacgtcaaagaccaaaggtagataaaatcagaaagatggggagaaaccagagcagaaaagctgaaaattctaaaaatcagagcatctcttctcttccaaaggattgcagctccttgccagcaacagaacaaaattggatggagaatgactgatgagctgacagaaatgggcttcaaaaggtcggtaataacaaacttttctgaggtaaagaaggatgttcgaacccattgcaaggaagctaatcttgaaaaaagattaggcgaatggctaactagaataaacagtgtggaggagaccttaaatgacctgatggagctgaaaaacatggcacaagaacttcgtgacacatgcacaagcttcagtagccaattcgatcaagtggaagaaagggtatcagtgactgaagatcaaattaatgaaataaagtgagaagacaaggttagagaaaaaagagtaaaaagaaatgaacaaagcctccaagaaatatgggactatgtgaaaataccaaatctacatttgactggtgtacctgaaagtgatggggagaaaggaaccaagttggaaaccactcttcaggatattatccaggagaacttccccaacctagcaaggcaggccaacattcgaattcaggaaatacagagaacgccacaaagatactcctcgagaagagcaaccccaagacacataattgtcagattcaccaaggttgaaatgaaggaaaaagtgttaaggacagccagagagaaaggtcaagttacccacaaagggaagcccatcagactaacagcggatctcttggcagaaaccctacaagccagaagagagtgggggccaatattcaacattcttaaagaaaagaattttcaacccagaatttcatacccagccaaactatgcttcgtaagcaaaggagaaataaaatcttttacagacaagaaaatgctgagagattttgtctctaccaggcctgccttacaagagctcctgaaggaagcactaaacatggaaagaaacaaccactaccagccactgcaaaaacatgccaaattgtaaagaccgttgatgctaggaagaaactgcatcaattaacgggcaaaataaccagctgacatgataacgacaggatcaaatttacacataataatgttaaccttaaatgtaaatgggctgaatgctccaattaaaagacacagactggcaaattggataaagagtcaagatccatcagagtgccatattcaggagacccatctcacatgcaaagatgcacataggctcaaaataaagggatggaagaagatctaccaagcaaatggaaagcaaaaaaaagcaggggttgcagtcctagtctccaataaaacagactttaaaccaacaaagatgaaaagagacaaagaaggccattgcataatggtaaagggatcaattcaacaagaagagctaactctcctaaatatatatgcatccaatacaggagcacccagattcataaagcaagtccttagagacctacaagagacttagactcccacacaataataatgggagactttaacaccccattgtcaatattagacagatcaatgagacagaaggttaacaaagatatccaggacttgaactcagctctgcagcaagcagacctaatagacatctacagcactctccaccccaaatcaacagaatatatattcttctcagcaccacatcacatttattctaaaatagaccacataattggaagtaaagcactcctcagtcaatgtaaaagaacagaaatcacaacaaactgtctctcagaccacagtgtaatcaaattagaactcaggattaagaaactcactcaaaaccgcacaactacatggaaactgaacaacctgctcctgaataactactgggtacataacgaaatgaaggcagaaataaagatgttctttgaaaccaatgagaaaaaagacacaatgtaccagaatctctgggacacatttaaagcagtctgtagagggaaatttatagcactaaatgctcacaagagatagcaggaaagatctataatcaacaccctaacatcacaactaaaagaactagagaaacaagaacaaacaaatgcaaaagctagcataaggcaagaaataactaagatcagagcagaactgaaagagatagagacacaaaaaacccttcaaaaaatcaatgaatccaggacctgtttttttgaaaacatcaacaaaattgatagaccaccagcaaggctaatgaagaagaaaagaagaatcaaatagatgcaataaaaagtgataaaggggatatcaccaccaatcccacagaaacagaaactaccatcagagaatactataaacacctctacacaaataaactagaaaatctagaagaaatggataaattcctgggcacatacaccctcccaagactaaaccaggaagaagttgaatctctgaatagaccaataacaggctctgaaattgaagcaataaatagcctaccaccaaaaaaagtccaggtccagatggattcacagccaaattctaccagagatacaaagaggagcttgtaccattcgttctgaaactattccaatcaatacaaaaagaggcaatcctccctaactcattttatgaggccagcatcatcctgataccaaagtctggcagagacacaacaaaaagaattttagaacaatatccctgatgaacattgatgcaaaaatcctcaatgaaatactggcaaaccgaatccagcagcacatcaaaaagcttatctcaatgatagactggattaaaaaaatgtggcacatatacaccatggaatactatgcagccataaaaatgatgagttcatgtcctttgtagggacatggatgaaattggaaatcatcattctcagtaaactatcgcaagaacaaaaaaacaaacaccgcatattcttactcataggtgggaattgaacaatgagaacacatggacacaggaaggggaatatcacactctggggacagttgtggggtggggtgggggagggatagcattgggagatatacctaatgctagatgacaagttagtgggtgcagcgcaccagcatggcacgtgtatacatatgtaactaagctgcacattgtgcacaagtaccctaaaacttaaagtgtaattaaaaaaaaaaaaaaaaagcttatccaccacaatcaagtcagcttcatccctgggatgcaaggctggttcaccatacacaaatcaataaatgtaatccatcacataaacagaagcaaagacaaaaaccacatgattatctcaatagatgcagaaaaggccttcaacaaaattcagcccttcatgctaaaaactctcaataaactaggtattgatggaacatatctcaaaataatcagagctatttatgacaaacccacagccgatatcatactgaatgggaaaaaactggaaacattccctttgaaaaccagcacaagacgagtatgccctctctcaccactcctattcaacatagtgttggaagttctggccaggacaatcaggcaagagaaagaaataaagagtattcaattaggaaaagaggaagtcaaattgtccctgtttgcagatgacatgattgtatgtttagaaaaccctatcatctcagcccaaaatctccttaagctgataagcaacttcagcaaagtctcaggatacaaaatcaatgtgcaaaaatcacaagcgttcctatacaccattaacagagagccaaatcatgagtgaactcccattcacaattgctacaaagagaataaaatacctaggaatccaacttacaagggatgtgaaggacctcttcaaggagaactacaaatcactgctcagcgagataaaagaggacacaaacaaatggaagaacattccatgcttgtagatacgacaaatcaatatcgtgaaaatggccatactgcccgaagtaatttatagattcaatgccatccccatcaagctaccaatgactttcttcacagattggaaaaaactatttttaaatttcatatggaatcaaaaaagagcatgcattgccaagacaatcctaagcaaaaagaataaagctggagacatcatgctacctgacttcaaactatattacaaggctacagtaaccaaaacagcatggtactggtaccaaaacagatagactaatggaacagaacagaggactcagaaattacaccacacatctacaacgatctgatctgtgacaaacctgacaaaaacaagaaatggggaaaggattccctatttaataaatgttgctgggaaaactggccagcgatatgtagaaagctgaaactggatcccttccttaaaccttgtacaaaaattaattcaagatggattgaagacttaaatgttagacctaaaaccataaaaaccccagaagaaaacctaggcaataccattcaggacataggcacgggcaaggacttcatgactaaaacaccaaaagcaatggcaacaaaaaccaaaggaaacacatgggatctaattaaactaaagagcttctgcacagcaagagaaactaccatcagagtgaacaggcatcctacagaatgggagaaaaattttgcaatctacctatctgacaaagggctaatccaaagtctacaaagaactcaaacaaatttacaagagaaaaacaaccccatcaaaaagtgggcaaaggatatgaacagacatttcttaaaagaagacatttatgcagccaacagacatgtgaagaaaatgctcatcatcactggtcatcagagaaatgcaaatcaaaaccacaatgagataccatctcatgccaattagaatggtaatcattaaaaagtcaggaaacaacagatgctggggaggatgtggagaaataggaatgcttttacactgttggtgggagtgtaaattagttcaaccattgtggaagacagtgtggtgactcctcaaggatctagaactagaattaccatttgacccagcaatcccattactgagtatatacccaaaggattataaatcatgctactataaagatacatgcacacatatgtttattttggcactattcacaaaagcaaagacttggaaccaacccaaatgtccaacaatgatagactggattaagaaaatgtggcacatataccccatggaatactatgcagccataaaaaaggatgagtttatttcctttgcagggacatggatgaagctggaaaccatcattctcagcaaactgtcacaaggacagaaaaccaaacactgcatgctctcactcgtaggtgggaattgaacagagatcagttggatacagggcagtgaacatcacacaccggggcctgtcgtggggtggggggcagggggagggatagcattaggagaaatacctaatgtaaatgacgggttgatgggtgcagcaaaccaacacagcacatgtatacatatgtaacaaacctgcacgttgtgcacatgtcccctagaacttaaattattttttaaaaaagaaagaaacattagaggggataattttattttcttaacaatgtcttttgactttttattatgaaaactctctctcatgtagagagatggcctattatatacctaaaacttagttctaaccaatgttaacattttgccgtattttcttcacctatttatttttatctgaaatattttaagagaaattgcaggttagcattttcttcctaaatcctttcaagtgcatttctttgaaaagagacatttccctacataatcacaataccattattacaaacctaataaaattaaaaatacgtgtgtaatttatattcattccaatttctccaaatgttcccaactgtcttttatagacatagtcaaagcaagatccaatccaagttgacatactacatttgaatgttatattaagaattatattaatattaagaatattcaatattcttaattctagaatcgtcttaaaggaacaactttattcccaattgaactgtggttaatgtatgaggacaacctaaatataggggcttgagagttattcaacccacaagcttccatgtaaatatgtgtagcctgaattagctcttttgattcatttggttctagtggggacatatttagcagcatttgtcactaggtctgaaaaatgtctttggctatgattatcctcctccttcaccatcttccccttcctccactgtactcattgtacaatccagaatcaatgtgaagtgcaactaagatagattgatttgtgttcttagataaaaagattggacggaaggccctagaattggaagcacttgatgtgacattgattctggccaggaagaacctatcccatggccagaatctcctccactgtctctgggctctgcgtgtgtttgcctccagtggtaagtgactctattgtggctctcggggatggcttccaaacctgggctgggacacatggaaactgcatgagggtctggttggaagaaaagcatgggtgagagatacacatggtggtcccagccagataaataaaagagactgacaatccagaggctgtggaggtgagaagttacttcatcatcttctccttagctgggtagagctcttgagtctgctcctagagatggacttcaatattgtttctccttggcagttacacattacagcattgtaggcttttctattcgtactacaaggtaaaaaaaggtctgtgacaggagaagggcagactttatttagtccttgtcacattcaagtgttatatctgggcagaatgactctcacatcacaaatctccctaccatattcctgaaattactcattgattacaacatcccttaccatttaaaaaaacccatgatccttctcaacagggtcctccaggtaattattaggaacatcattgctcagttgatatttatttgctatctcttgatttgacttatttctaattatcatagtaattttgtatttagacccataattttatagttttgaaaaagaaactttaaagagtaaagcagggccaggcatggtggctcacgcctgtaatcccagcactttgggaggatgaggtggtcagatcgcttgagcccaggcatttgagaccagcttggtctctgctaaaaatacaaaaacttagctgggcatggtggcatgtgcctatagtcccagctacttggaaggctgaggaaggagaatcacttgagcccaggaagtcatggctgcagtgagcattgattgtgaccctgcactccagcctgggtgacagagtgagaccttgtcttaaaaaaataaaaaaagtgaagcgattgcttgaattcatacagataaaaagtcaggagggtggaatttctaactccagagctcattttaattctattccatatggaaactttttattaatacgttagatcctataccttctatctgatatgtaatgagcatagactttcatttctcctttccgagttcccttcctatgaaatgaaagtgacaattatttagaggttatatagttgataggggaaagaacgtgggcttagagccaaaaagacctgagtttgactgtggttctttttttaatgagtcataaagcatgaatacttaccctgttgaacctcagtttcatcctttacaaaattacagtagtaataatgattaccattactctgctagggctgccttaatgccttaacaaaatatcacagtctatgtggcttaaacaaaagaaatgtattttctcactttatttttttaatttttttttatttttttgagatgaagtctcactcttttgcctaggctggagtgcactggtgtgaccttagttcactgcaatctctgcctcccaggttcaagcaattctcttgtctcagcctcccgagtagctgggatcacagggacctgccatcatgcctggctaatttttatattttagtagggacagggtttcaccatgttggtcagactggtgtcgaactcctgatcacaggtgatctgcccatcttggcctcccaaattactggaattacaggcgtgagccaccatgccctttttttctcacatttttgaaggctacaatttggagctcaggatgtcggcagatttggtttctactggcccctctctttggcttccagatggctggctgctccctgtgtcctcacaaggtctttcttctatgcttgggcatccttgatgtttctttgtgtgtccaaattctcccttcttataaggacataagtccacattagactaggacccaccttaatggcctcattttaagttccctctctaaaggccctatctccagatacagtcctactccgaggtactgaagattagggcttcaatgtatgaatttaggagtggacacaactagccataatggagctcatagacttggtagatggggtgaatgggagaatgttcatgggcatgttcgtcacatggcaactgcttgataattgctagtttctcttccccgccctatgcttttcccttagtcttttgaaatagtagaatgagtacagatatggggagttaataggtgactttttatttctaattaccccaagaactactaaaatgcctgattttttttcttttctttcttttttcttttctttcttttttttttttttttagacagtctcgttctgtcacccaggctggaatgtagtggcatgatcttggctcactgcagcctctgcctcctgggttcaaatgattctcgtgccttagcctcccgactagctgggattacagttgtgcactactacacctggctaatttttgtatttttagtaaagacggagtttcaccatgttggccaggctggtcttgaactcctgacctcaggtgatccacccacctcagcctcccaaagtgctgagattataagtgtgagccactgtgcctggccacaataacctgattttcattggtaaattctcttaataaacatggaggattcataaaaagaaggtatttctgggggaataatgggatagatgcttgaatccttgttcacagatggagcctctactcacctatctcccgtatattgacctgaacaccagagagcattagggaaaggctgagtagatttgcatacacccatctctaataaaggaaaagaggaactgtggctttatataaaggacaactctcattaatgaatagacagaaggtgtgccacccacatttgcagtgtgccagcagagcgaaatttgaagcatttcctggtttcctaaagcataaataggctgaaaaacttgccttccttaaatataatggttatggagatttagaaaaattccttcagctgagttctgagaagtcctgggattttcctgtgggtatgaggaggtggctatctgattcatcttctaagcctacgttgattgtaccaactcactgttccataaggtatttaaaaaaattatactgtcactctccatacattcactttactgatgagaggtaagcagagttcaagaagcctgcggattactatcttttccgtcaattgttagccactgttgaatgttccagcaaagctttctaaacagctcctatcttcagaaggagttggctggaaccctaatgggtctgtgagagccaatgaaccctttggaagttctcagatggccaatgaggatgttcacagagctgccggagctctaacctcggacaggcatccacaaaagtgaactcagtgaggatttcttattgttatcctcttccaatttcaagcctaaaatcttccatgttagaatcagtgcttttaaaattaactcctcccttactcaataccagaattttttttaattacttgccaagagttttctctagtctgttttcccaattcggaagtaagagctgaatgagtagccacaagagtggaagattgatgggcaggactaggatgccaaatctctgaattttgatccaggcaattacttcatgtactagcctcaggagggacatatgcatggacgatgttccaggaacatgcactctgcaatagcaaagacatcagcctcagtctctatctgaaagactgtagtgagatgaggaagcttcagatttccatttagcttcctttcctgagggttggagcaattcagtatcatccacccttgtttccctctctttgcttctctaagacctcttgttcccactcacttttctcagatcaaggctagcctaaagcacaaggcattcataggtctttgtcttaaaaacacaagtccagtggaggaaagacagacgagagtgtctgtggactcctcttattttctgacatgagcagagctctacctaaagtgatctaagtggaatagggtactgggaatgttggagagacgctggggcatccttggagacaagagtaatatccaaaagttgtatttacctaaccagatacctctttggagtttctttctatcattcagatctatgaaaatgttttgataatcacccaattggccaaaaaggcaaaaacttcccagtctagttactgctgagcaggaagaactgattcttcatttgacattctagttgcggcacagtcaagtcattaccttagtcatgggagacccgagaatgacattatagaggaatgtgcaaccagggtggaaaagaaagggagctatcttgtttatcaagttgccccttaaagatttaaaggagtcaatccaagttgtcttgagccttaactcatccacttgtgaccataactactgtgcttttgtttttcttagtctccatgggagccatgctgggaattaatggagccatggaactgcttttcaaggttattactccttacacccgaaagcgcacccaagcaatcaggtacagagtgccatgtaatacttctgccccttttgtaacagatggagagatggagattgccctacatgtattttcatgatgcttccagctcagtttagtggtcatttctcctttggaaatatggtaccatgtctttatcctttctcagtttacatccctccacacccatgagtcatttcctctaattctcatcaaaaccctgaatgggtatattattattctctttttcagacgagcaagttaaaatatgtcgagagccttatccaaggtccctgtggtagcaaatagtagagttgagatttgattccagatctttcagactcgaaacctcatgttctttttgcctgaagccctcaggtatatactttttactcgcagcaaatctaccataaataaatataatcctcaaaagacatttcataaatgacagggtctctaaagagacagccagttaaacttctggcatgagttctgggccttataatagtccatcatggtcatgtgctagtcttgagatgtatttttatgattggaaaatgaaactcagcctgttctccctgcctctgcttgctggagtggagtgaatcatcaagttaaaaagggagatggttagacatgaaggctttagagatattcgggactattaagatctatcatttatgggagtgactcagcgaggaccttgaaagaatattagaagaaattcagccaatttccaagatagatgggatcatttggcaagtaacatttccatgcccaaccatgatattttctgcatctcagcgtcaatcttagcctcatattccacctgattatttttctcttgggtcactacagttatgccattatcatccattctcacctgcagctctctacaccaagcatttcgtagagtgaaatacattatatctcagtgaaaaaaaattctcatccagtaagttgagaaatactggattgaatgctggtttctttactgtaagacttctcagagcctttgtaaagccaatacatattgagaatatctgttatttagtataccctgatccaaaattgatttagtcagggaactgtggtttttttttttttttttttttgagatcaccttttttaggggaaggaggggtcagtgttctatgtctctcattttggaaacatcttctccagggtgtgaatttattgcaaggtggaattcaattaaattctgctaagaaccctcatctagtaggtaaaaaacttcaaaataaaaaactcagggaccaaaaaaatttattttctatgattatattttactctgtcttaaatttacatttatgtcagataacaagaaatataaaccagtgtcttatcaggaatctaagtcaaattagtgagtctttggttcatccagggatttcactcttctccccccacttcctggggtacatctgagttctaagaagccatggtagtgctggggtgttgatggaaaaacacagactgtcctcaatcatctcatgtccatttggacatatatatgacttggatatgtctcatttttatcattgtgtgcaggcctttgctgctgacatctgcagtctcaacatgttctttggttaccaatctatgaactttatctttctgccctattcacaaggcttcttctaatctgatgctgtcataattcagctgttcagaaggtcaggaatatctggtttcttcctttagattatgtgcaaatctttgtgatatttgctgggctcatccacatacgggtctcactcagtcttctcctctgccacttgggtaccatgttgtttggaaggctcccctaggaagctcttcccacatagccatgggtatcaaggcactaggtctcttccttctggggtgctcacatagcttttattgtcttcctcattcaggccaaacttgtggggtagcggggagaaatcaacaaagcatagaaacctcttcctcagagactcacactagttgccatttttaatgctttcttttcctcctgcaaagggagttgaattcaggcacagatctgatcaaagtgtcagaggcaagtgggaaagtaataccagggattaagggagtgagagtagggtgctcccaatcacaaaaggagccttccagggattccaggcatatttctacatgtctgatttgttttgtaaattttgggcaagatggttttccttcttcagtcaaatgccatattaaaaccaaacctctgtaggaaagaggcttttccaccaaccgttacaatatagctgtcattggcatggtgtttatgaggtgccctgcactgtgctaagctcttagcatgcattacttcctttgagcctctcatctgctctgcaaggcgggtgctattattgcccccaattttaccggaaaataaattgaaactgaaagaagttaagtaacatgctgggttttaagtgagagagctgggatttaaaccctgtctgatacatgagcctcagctcttaagccaccactggcgtatcttatacagtctatttccagcattttatttctacaaccatcatatgtaagacgatcatatgcagttaaagtttgcttaaatttcttttccatctaaatggcttatacccatggaacaatttgcttaatgatagaggagtcttactcctccatcagttggctatttcctctcaaaggctaaatatctattccctctgcttttgaattctttcccaaagctaccttgttttctatcttatccttactcatcaacagcaagataagaacaaaggtaatgaaattggaagacctgctctgtaagcctccttctaccagattccttggcgagtcatttaacttttcttaactaaactttgacatttcttaaagcatgaatgtcaagtcttacctcctaggtttattgtgggcaataacaaataatgtgtaaagacatcgtgtgctttgacatgctatgacattgttaatcattattaatacaaatactatgggatgtctggttgcctgctgcagatcagatggcagaggctggggaagagtctggagatgagaacgtcctgccaatttccatctttcacaaactccatcctgagaatagtaactaagacatacccaaatgaattctactcaagccatttggttgacagaacctgtgggctcaaggggggtcttgcagggaagggataaagtcgcatgtcagggggcatggatagctctactaagtatcatcctccaaatgctagcatgctatgggagagttattccgggatgcctttgtaggagcagatgcccagtgttgtgtcatgatgactcctccctcctgtggagattagacctgccctacttctctagcaggaacctaaaattagatgtgcagctgtcctccaatgaagctctgtctccagatagtactcagggcaagatttacaacagaagctccaaccacatacttgctagagagaagggacatgaagagcaatgtcactaaccctctgtggccttgtgccagccctcagcccagggcaggcagctatttcaggcctcctccacttcccaaatacccaccatgctgcacacacttgtgttggcttgtgccaacttccttccttcggctcctcatgagtcccatgctagtgggaacagttatggtcagacttaaactgctatgatagccctctagttggtctcacttcacttcaaagccatcaggaatgtgcctcagcttccctttccagagtggtttctcattcctgctctcatctcgctttccagccagctatctctgagtgtggcattccctcttcttccccaggtctctcccttcctctggaatgccatgctgccttgtgcagtggtagaagtcttacccagtctccagacttcactggatgccacctgctccatttcatcagagaaaaggaatctactctcctcaaacatcctccagagatttgttcagaccttctttcgacatgcattctattggactctgtactatattggcctgggtgtcttttctcctccctaaattctgtacttcctaaagtagaaatcaaattatatgtatcttgttattttccattcctcctagcccagcgcctagataataataggctcttaattaaattcaaacgaggctgagcatggtggctcatgtctgtaatctcagtgctttgggaggcaaaggcgggaggaccgcttgaggccaggagtttgcgaccagcttgggcaacgtaggcagaccctgtctctacaagaaattagttgggtgtggtggtgcacacctgtagtcccagctactcaggaggctgaggtgggagagttgcttgggcccaggagtttgagactacagtgagtcatgactatgccattgcatgccagcctgggggacaaattgagatcctgtcttaaaaataaataaatgagggctgggtattgtggctcatgcctgtaatcccagcactttgggaggctgaggtgggtgggtcacctaagatcaggagtttgagaccagcctggccaacgtgatgaaaccctatctctactaaaaatacaaaaattagctgggcatggtggtggattcctgtaatcccagctacctgggaggctgaggcaggagaatcactcaaacccaggaggtagaggttacagtgagccaagatcacaccactgcactccagcctgtgagacagagtgagattctgtctcaaaaaaaaatgaataaataaaattaaataaatacattgaaaagaaatattttaaaaaaaattattggtgaatttcctatgtagtaatgaatgaaagccagaatgtactgagtaggtgctatgctaggcacttcatatttgttaccttttttccccctgataccaggctggctgcacatgcagagttctgccccatccaaacatgtctgaaacatcagttggcacacctcccaagagctctattgcatgagggaatgaggtgccttctgggagagaactcattctgagagactgcgaagcagcagccaccagcttgaaagggagcaaagtttctctcactggagggaagaaaaaagttcagagtcttttagagttgtctgggggaaccgacagagattggagcagggaaagatctgaattggaggggcatgtggggacagcattcacattaaaactttgctgtctatttgaaataggcttctagtgtttggtctgttaatgaactcagctggggcttaaacttttctgggggtgctttttatagaagtagggaggaggaaatgacactgggccagagtgtgctacctcttgctcgtttgttccactgtggacaagcttgtttatctgcactaaagctgtctttgagctgtccaaactcactaagtagggaaatttattgaggcagacagattacttgtctgcgaatgactcatcttgtgaccttaggaaagcttgtgattactccacgtctcaacactttctgcgggaggctgtccctttgtgccgtcattcccaggatgggcctgaagattttgataataataaggaccatttccactggccacgtgcttgaccttttccaaagtacagccacatcccctctgatccttttggattctcacagtgtaatattgaacccaacctttggaactgggttatcagatgttgtcatcagtgtgtcttccaggattttaaactctgctggcttgccttgctttataagtatcatagccaattggaaatgggttggatcttcctagcagagaccaggtcttgaagcccattgtattctctgaccattgctccacacttccagaaagaggactcgggctgctcacaggctgggatagctccctcaccgctcaccttcattttctctggagctgccccaaggacacaggaagtcaggaagtgttttgctcaagaccatgctggtctcaccctcacagaggataacatctttagtatccccaccttcttaatgccctctcaggttttcagcaggaaggtcatgctatgatttatctctttaccctcagggtcagtctcatgttatgagattgtggaggtcggagtacctgggcttaaacaccttggcaacgggaggagatggatatgtttggtcttcaagcaagcttcataagcaaattcttcaccttagtctcctgttggctgtcctagtagctccttgtgcttggaatagtgttaggtgatattctccctccaaaggaccaatcttctagggcctccctggccttagaattctgcctgagtgcaggattactgggcattgctttattggcagccctttctggtgatttcatctgcaatttatgagctagaaaaaatgtcctgcttctcttctccctgcccccaaatcactcactgcctctgcccaaagccgggtcttctgggctttctccaaccatcactccattccactttatctgatcatagtaactgatagatgagtgagactcagccagagctaatggattccatgagatcatgagtgagtgggtgactcagctactcttcactgagacaatggagatccaagttagaagaaatggatttttttctgtttcttaaaatagttactgaattccccctgggttttaattccctcccagccccaactaacggcttcatgattccccattcaacattagagtctgtggtctccagggcatggcctcacagtggggcttcactctatgtctcagcactttctgcttgtaccttgtctccagagcactccaattcaaataccttggaacaggagcaaaaaaattccaccccagcctcacaagcgctgatattgggggcgtgcaccatgagctcaagttactagcagagttattattgcatctgcaacctgactccaagcctgtagctgatggggaatgaatagtttcttacatgaattaagccttggcaactagagttatagggttaaagccctttcatcttcttaagaagccactgagctcttcctgataagggcaagccatagatattcaagttgtaggatctaaagttcgaaggtcttaagggaccttcttatcatctccttcatcttaaaatgaggtcactgaaacccagagaggctgaaccaagccttctaccctaacttcaaggcaccatttattactccaagacacttttctgcatattacaaaacaaacatgctttgaattaggacttttatttgacaacattctatgtgcctgtctcaatgttaagtgctggagaaatgttgcttggggacctcaagttgccgacagcctatgccaacaagaatgatgtagtgtatgaggaaggccttgcattctgatccagtcttgggcttgtgaaatgaccagctccctatcctgtggaaatgcctttataatgcctttctcagaaaagcccacagagctgagcagacagggcctctgctttgggctctgggcctcaggcgaccctacactttggagagtcttccttgaaatgtctcaggtattcttttggtgcttgagaagggcttggtctggcagtgccatccaggggggctctagtccctgtttctcacctttgaggtgttctctaatcccctgtcacctgggtggtgaaccagattccttcaggaggaggagctcaggaactcatcctgcgtgtgggttgtcctgattcaggtgtgttggactggtgagcagatctttcccattgctggttctgtatttattcctgaggatgacatgctggacagtgagaagggtgcttgatatgttgatattggatggatcaaataagttacacagacaggcctccaaaaacaaaacaagacaaacctcccttggtccttcatatcctggggaggccttacatgcaccactttcccctgatgacggtcctctacagaaattgcatttccacctttatctgctgaagcttgtacagctcgtacctccctatagatttccctcagttttccctctagagactagaggcaggctctaggaactttcacttgccatagaagttaatcttcttgcccagcctgactcagtgaggagcttatgcaaagaaatttgtattttcctgtaaatcacaccttcctcacaacactgtaaccacctacaaatatggaggaaagggagtttgaggaacttgggggaggtatggaaagactcttatcaggagggactcttgtggtttcaccttttactttgagggaactgatatttcttttttacttttcttttttttttttttgagatcaagtctcactccgttgcccaggctggagtgcagtggcctgatcctggctcgctgcaacctccacctcctgggttcaagcgattgtcctgcctcagcctcccaagtagctgggattacaggtgcccaccatcatgcccagctaatttttatatttttagtagagatggggtttcaccatgttggccaggctgatcttgaactcctgacctcaggcagtccgcctacctcagcctcccaaagtgctgggattataggcgtgaaccgccatgcctggcccgggaactgatatttctaatagaattctaaattcttcagggatggattccacactcaggcaccataaattataaagcagatgggggaagaaaacacactctggttttcctgtggggttgtgagagggtgcagtgtctggagatgtgcttgtttagcagagacaagccaactcagttggctgggaaggaaagggtcaaaaggaggccatcacacaaatgtgtagccatggaaagctagctgcttttaagagtttaggcagagattgtaggatgaggacagattgaaagctttctgcctaagttcaattatagtgctattttaatattagctctctatgtgatcattagtcatcttcaacaaagctaatgagaaaaatgagtagagaacaataaatggttatttaaaaggagtgaattagtagagatcaggtctgagtttctttcatatggtgcatcataggtattcaataaatgccagttgaatgaatgaacactgttgttttggtttgcctgagttgtcctcttttaactatccattgattcattcagcagtattgtggggcttttattattgtcagagatttgtgggcattgagttgaaaagacacagtccttgccctcaaggattgtattgatacatgcacacattagcatgtaaacaaataagattaatgtgatcatgggggggatatttaagagggagggtttcagtctgctcaggaattagcaaggaggaactcactgagagggcagcttttgatttgaaatagggaaggaatttctggatgttaattttataagagcaccacgttctaggcagaggcagaagcaagagcaaagacaaaaaagcatgaaaacaatgagtgatatgtatcaagacaaaaaaattcctattccttaacccaatttttcttttcttaaactatgtcctaaaaattcactttgaaatgtgaactaagatttatgtgcaaaaatatcaatcacagtattatttataattggaaatattataacctgaaaaagctcaataatagggaatgcttggtaaaagtgatatgtttccatatcatattatgaagcaacacacaaaaataggttaggaacgatgtttgttgtgggaaacagcttatgataaaatattgactagaaaaagtaagtctcaaagttcagagtgatataatctacattcccagcagcatatgaatgtccatttaattgaatcctcaccaacaataaatattaccatttttctaaatttttattactttgatttctgagattgttgtcttgatctcaattgcatttctgtgattattggatagttgaatatttttaagagtttctctgttttttatttcctctttgtgaattacatattcccattcttctgttgtctactaagatattagtgttctcaccttaaaaaacaaactagagataaaatatataaaccaatgttgatggacattaggcaacgaagggcagtgattcctgagagataagcccttaaattcccccagctcattgtcttagagagtttctagattgcagtgcagggacaatgaactgacttgcagcccagcagactccctgagttaaagaaacagttgggagacagagctgaaggcctggagaaaccaaggtgcatagcatttgtaggacagagtcctagaaagaaagctgcacagaaggaaaactctggagatcttcagggattaccctcaggtatttagctggatatgcaagcgtacttatagggaaattagccaaagccaaggaaagaccacctgcaggaaatggagggaacaatatctgacacacacacaggactggaagtagtacttggttctgaaagacagactggaaaacctcatgactcatgggacattggataaagtacacaggatttttcctcagtagggaggaataaagtcatccctcgatattcatagaggataggttacaagacctcttgtagataccaaaatctgtggaggcccaagtccttcatataaaatattgcaatagtcgcatataacttatgcacttcctcctgtatacttttaaatctttaaattacttataatacctacaaatgtaaatgctatgtaaataagttgttagactgtattgtttagggaataatgacaaggaaaaatctgttcatattcagcacagatgcaatttttaaaaatatatttaatccacagttggttgaatccatgtgtgtggaacccatgaatacagagctgactgttgttacctctagactgagcgttagctgtagaccagggctctggtcctgccaaacaaatattaaaagcaaaaccttgaatcatagaactacttccaagtaaattagctgcatcccaagtcaaagcctcagaatatttattggaacacaaaaatattcagcactaagtgaggtaaaatcacaatgtgtagaatccaagaagaaattatcaggcatgcaaaggaacaagaaagcactacccatgaggaggagataatttattcaatcaaaaccagaactgagatagatgttataattattaggcaagaacattaaagagctattctaactatatttcacatgttcaaaaattaagtaatgacacagaagatataagaaaaacccaaattgaacctctggagatgaaatctacagtgtgtaggagaaaaacacactggattgaattaaagaaaattagatgtggcagaagagaagattagtttgaaaatacagaaacagaacatttccaaaatgaaacacacagagaagagatttgagaagaagagagcactagtgaactatgggacaacttcaagcagcccagtacatataatttgagccactggggagaggagaaataggtagggacagaaaaaaatatttgaggaaataaaggcttaaatctctgagatacaataaaaatgatagggacacaggaaaccatgtgcataagaaacatgaaaaaaacgacttcaaggaaaatcataattaaacttctcaaaaccagccaggtgtggtggcttatgcctgtaatcccagcactttgggaggctgagttgggcagattgcctgagctcaggagttcgagaccaccctgggcaacatggtgaaacccccctctctattaaaaatacaaaaattagctgggcatggtggctcatgcctgtaatcccagctactcaggaggctgaggcaggagaattgcttgaaccaggtggatgaatgttgcagtgagccgagatcacaccactgcactccagcctgggcgactgagcaagactctgtctccacaaaaacaaaaacaaacaaaaaactcaaaaccaatgacaaaaaaaaaaaaaatcttcaaagcacccaggaaaggaaaaaagatgcattatgtacacagaaacaaaaataagaatctaacagatttcttgttggaaacaatgcaagtgaaaaaacaatggtgcagcatttttgaagtatggaattctgtactcagtgaaaatagcttttaaaactgctgatgaaataaagacttttcggacatacaaaaactaaaagacatcatcaacagcagactctcacgccaagaaatattaaaagaaaactttaggcagaaggaaaatgatacgagtggaaagatgtatctattcaaaagaccaaggagcactagaaatggtaacatgagtaaatatatttgattttagattattattttagtctctttaaaaatagctaagtatttaaataaaggtaatctcaatgtagtctggagtttatattttttgtaaaattaaaatatatgacaacaagagcacaaagatcaggaagagagaaataaaagtattctattgtaagtgtcttatgtattaaatggtatattaacaattaaatgtagactatgataatttgaaaacgtacactaaagcaaccactaaaacagttaagagttacggctaatgagttgacaagaaggtaaattgttataaaaacattcaattcatccaaaagaagccaggaaaagagaaaaaggtagttgaaggacaggtgtcacaaatagacaaaaaattaacaggaatgtagacttaaacctaaccataactcctgagtggagttcctctccactcagatgtcaatgttgcatactctatgtaagggcaaatatataatcatattgataaacaagttactcaattctgctgcatataagaaccacaattcacaattgcaagaatatagaaccagcccaaatgcccaccaatcaacaaatggataaagaaattgtggtataaatataccgtgggataccacttagccataaaaagaaacaaaatagtggcattcacaacaacctagatgaaattggtgactattattctaagtgaagtaactcaagaataaaaaaccaaacatcttatgttctcactcgtaagtgggagccaagctgtgagtgtgcaaagtcataagaatgttaaaatggactttggagacttggggaaagggtgggaggagtgtaagggataaaagactacgcattgggtacagtgtgcagtgctcaggtgatggtgcaccaaaatctcagaaatcaccattaaagaacttattcatgtaatcatcacctgttctccaaaaacctattgaaataaaaaaattaaaattgtgctgcatataagaaacacacttaaaattttttattggtatatagtaattatacatgtttatagagcacatgtgatattttgatacattcacacaatgtgtaatgataaaatcagagtgtttaggatatccatcaccttgggcagttatcatttctttgtgttgggaatatttcaaatcttctagttattttgaaatagatatcgttgttacctatcatcacttcactatgctattgaacactggaatctattccttctatctaactgtgtttgtacccacattaaccgatttctcttctcccttccccactcccagcctctggtaactatcattcgactttcatccccatgagatcaactttttagctcagacatgtgactgagaaaaatgtgagtggtagttgtctgtgtctcgcttatttcacttaacataatgaccttcagatccatccatgttgctgcaaatgacaggatttcattcttgtttaatggtggactagtattccattatggatatagaccacatttaaaaaatccatttatctgttgataaacacttaggttgattccatatcttggctcttgcgaatagtgctgcaataaacatgggaagcaggtatctctttaatatactgatttcctttcttttggttaaatattcaatagcgtgattactggattgcatgatagtcctatttttagttttttttcaaaacctgcatattgttttctataatggctgtataaatttagattctgactaacaggctatacgagttcccttttctccacatccttgccagcatctgttatttttttgtctttttgataacagccattctaactaaagtaagatgatatctcattgcggttttgatttgtgttttcttggtgattcgtgatagtgagcattttttcatatatctgttggccacctgtatgtcttcttttgagaaatgtctatttagatcctttgcccactttattattatcattttctccatttaagctgttggcattcatcaatactctcagatgtctctaccaacataggcttcatcagaaacctttgtctactttttaatggaattatatgttttcttgctattgaattgggttccttgtatattctggttattagtcccccgccagagagtttgcaaatattttttttttcattcagcaggttgtctcttcattctgctgattgtttccttttctgtgcagaagctttttcgtttaatgtagtcccatttgtctgtttgtgtttttgttgcctgtgcttttgagatcttagccataaaatctttaaccagaccaaccttctgaagaatttctccagtgttttcttctagtagtttcatagttttgggttttatatttaagtctttaatccattctgtgttgatttttgtatgtgccgagaggtaggggtctagtttcactcttctgcatgtggatatccagttttcccatcatcatttattgaagagggtgtcctttccccaaaggatgttgttggtgcttttttcaaaaatcaattggctacaaataggtgaatatctttctgggttttctgttctgctgtgctggtctgtatgtctgtttctatgatagtaccatgctgatttggttgctatagctttgtattatattttgaaggcaggtagtgtaatgcctccagctttgttcattttgcttaggattgcttcggctattttgggtgttttgtggtttcatatgaattttggaggtttttctctatttctgtgaaggatgtcattggtattttgatgggggttgcattgaatctgtagattgctttggagtagtatagtctcaagattaattttaacaatatcaattctttcaatccatgagcatgggtgtctttccatttgtttgtgtccttttcaatttcttcatcagtgttttgtagttttccttctagaggtctttcacctattggttaaatttatttctaggcattttgttattttttgtagctattgtaaatgggattgcttttttgatttatttttcagctagtttcttattagtgatagaaatactactgatatttgttgattttgtatcctgagactttactgaattcagtgatcagttctaagagtttttttggtgtagtcttggtttttctaaatataataagatcacgttatataaaaagagagacaatttgactttctgttttccaatttaagtgccttttatttctttctcttgctagagattgttccggctagaactgtcagtactatgttgagtatgaatagtgatagtgggcattgttgtcttgttccagttctcagaggaaattctctcagcttttctccatttattatgatactagctgggtttgtcacatgtggcttttattatgtttcttatgttttattatgtttcttatgttttattatgtttcttatgttttattatgtttctactatgcctaatttgttaagagttttttatcatgaaggaatgttcaattttatgaaatgccttttctacatcttttgggaagactgtatggtttttatcttccattctgtttatatgatatgtcacagttattgatttgtatatgttgaaccatccttgcactcctgggttaaatcccccttgatcatggtatattatctttttgatgtgttgttggtttgctagtattttgtttgctatattttgttgaggacttttgcatctatgttcattagggatattgatctataggtttctttttttgttgtatccttgtttcgtttcagtattagggtaatgctggttttgtagaatgagttaggaagaattccctcctctttaattttttggagtaattctagaaaaattggtgttagtacttccttataagtttggtagaattcatcagtaaagtcatctggtcctgagtttttgttcttgttgttgttgttaggggactttttattactcattcaatcttgtactcattattattctgttcagatttcctatttcttcctggttcaatcttggtagattgtatgtatccagggattcatcattttcctctaggttttctgatttgctagcatatagttgttcataatagcatctaattattctttgtacttctgtggtatcaggagtaatacctcctgtgtcatttctgactttatttatttgggtcttctctcttttttgttagtcagttagcagtttattgattttatttattttttaaaaacttcatttcattgatcctttgtatttttttagtctctatttcatttagttctgctctgatctttattattcctttctttctactaattttgggtttggtttgttcttgcttttctagttccttgaggtgcatcactaaattgtttatttgaaattttctacttttttgacatagtcacttttttgctataaacttctcttagcaccacttttactgtattccacagattttggtatgttgtaattttactttcatttatttcaagaatttttaaatttccttctcagtgtcttccttgactcaatggccattcaagagcatgttgtttaatttcacgtatttccatatttccttttattattgagttctagttttattccactgtgatctgaaaagatacttgataggattttgatgcttaaaatttactgagattaattttgtggcctaacatatggtctgtcctggggaatgttccatgtgctgatgagaggaatgtgtattctgtagctgtttggtgaaatgttctgtaaatgttaggtctacgtgttctcaggtgcagtctaaatccaatgtttttttgctgattttctgtctagattatctgtccaatgctgaaagtgaggtgttgaattccccaactattattgaattggagtctatctctccagtaaggtcattggtgggtagagcaggttaatctccaagttccctgattgtgctagcatggggaatgatgccaggtgaggcagaactgtcctgaagcctgctgatggtgcacataagcacccaaactggcaagcattattgatgtgtaggtccctagatggtgtggtcatggtggtggcagtggtgaggacaggcttgtcttcaggccccaggaaggctcccagacagaccagactccaagcctgctgaaagcacatgcatgtgcagagtgtctgtgtctggggatgcaaggttgctgtcagtggcagcagccccagtcaggtggctctcaggttccggggagtgcatgcttcagctccctttgtcctggagaaagcttccctggtgcactgcactgccattcactagggtgtagaacaccgcgtgggctagagtgctggggacctggctgcaatgctgggtccagccagcctacttggtggacatgaggaaatatcagtggggctccatggatgtggaaattcaggggctgttgggccccagggcaggatatcatctggtggggcctgggctcttaaaatggctgtgtgctgcagctgcttgggtctggggagtgtgtgggatccagcctaaactacatctctggaacaatgtcatggtatgaactctaggcagcttcatatactagtttcagggcccatgagggctgaggggctctcctgtggctaggattgcaggagtctgtgggaatgtggagtcctggggatcctttgctcaccttttccctgcattatggagtttcttctgacacagagctgttcttaatcctggccaggctagatgcttagcttccctctccttccatgcctcagagattccctgggtgcctccaggtagccatcttgaagtctctccactcagagctgtgtataaacacattttaaatataaagacttgagtgggttaaaagtaaaaggatgaaaaagatataccaagctaatgataatcaaaagaaagctaggaagctttttctaatatcaaataaagtagctttcagagcatagcatattgccaggtataaaaaggtaattccgtaatagtaaagggtcagtttattaggaacaaacaaaagtcctaaatgtttacctaataacagagcttcaaaataattgacgtaaaaactgatagaactgcaaggaaaaatagatagatccatgactttagttggagattttaataaccctttctgaataattgatagaataagtagagagaaaatcagtaagaatatagatgatttaaataacactatcaatgaatgtggcttaactgatattcataggatactttacccacctacagcagactatacattcttttcaactgcaatggaatttttacaaagatagataatattatgaaccataaagccagtcacaatgaatttataagaattcaaatgatattgagtatgttctatgaccacaaggaaattaaattatcaacaacagaaaggtttctgtaagagtccccaaaatttgaaaattaaataatgtacttctaaaggaactataggtcaaagaagaaatcaaaagtgaaactagaaagtatcttgaactgaatgaaatgagtatagcatattaaaatctctgggatgccacattcttgggggaaatttatagaccagtaggcacatatcagaaaagaagaaagatggaatctctaatcaacaacctcagcttccaccataagaaaggataaaaagaagactgaaatataaagtaagtaaaatgaaggaaataagaaaaatcagaatagaaataaataaaattacaaatagaaaaacaataagcaattcaatcaaaagttggttctttgagatcaataaaattgataaaacttcattccaggctgggcatggtggttcacacctgtaatcccagcactttgggaggccaaggtgggcagatcacgaggtcagcagatcaagaccatcctggccaacgtgatgtaaccctgtctctactaaaaatacaaaaatttagttgggtgtggtggcacctgcccgtaatcccagctacgtgggaggctgaggcaggagaatcccttgaaccagggagttggaggttgcagtgagccaaggtcacaccactgcactccagcccgatgacagagcgagactctgccaaaacaaaacaaacaaacaaacaaaaaatccaatccagactgataagaaaaagagagaagacacaaatgaccagtatcagaaatgagaggcgaaattcctacaatttctgtagatatgcaaaggataacaaggaaatactacgaacaactttgtgccaataaattggacaacttagatgaaatggaaaaatttcttgagagacataactatcaaagctcacccaagaagaaaaagataacctatatagccctatatttggtaattgaattgaatgtatggttaaattatccccacaaagaaaagtctaggtttagataagttccctggcgaattctaccaaacatttaaaaataaataataaaaattctgtacaaactcttggagaaaatttaagaagagacaatattttctaacttattcaatgaagccagcgttaccctgataccaaaagcaggcaaagactttacaaagaaggaaaacttccaaccaatatctctcttttttaaaatattcatacaatggaattttattcagccatagaaaggaatgacattctgacacatgctacaacatgagtaaactttgcaaacatccctgactgacgaggggctcctgggctctcaatgcaatagaaattgacatggggccaaaggcttttcccagacaaagcatgcgaagggtagaggatataggttagcatcatctggttgtgatgattatcttgagtaatgggccacctggtggtctggccagcagcaacaaggctgtaaatcaattaattattcagcattccctcccaagatggggcactctgcaatcttgattccttattttggatctcctaaggccagttcctggaattgtttaagtaaaagacatggttaagcattatgagagcacagaagaacaatatagaaaggccattttctttgtatgactaaagcctcgaggttagcaggtatggtgttgacaccaatatcttttaagaacagagatgcaaatattcttaacccaattttagtaaattgttatcgacaatatatacaagatcaagatcaagtgatatttgttgcaagaatgcaagactagtttaacacgtgtagaaatcattatatatgattgattatataaaaaattaagaaaacccgacaatatatgattatctccatggacccagaaaaaacatttgacaagatctaccatttcccaataaaaagcgcaatacattagaaatagaagggaactttctcaataaatcacatctatgaaaactgttaagccacatcatacttcatggttaaaagactgaatgcttccccagtaagatcagaaaaaaaactagactgtctactgtcattaaatctatttaacattatactggcgattctagtcagtgaaataaggcaaggaaaagaactaaaagacatccatctgggtaaagaagatgtaaaactatttgcagatgattatctttgtagaaattccaacggaatctatacacaaaaaattacaagaactaataagtgagtttaccaaggttccaggatgcaagatcaacatacaaaaaatttatatttctacatagtgcaacaaattattggaaatacatcactgaaaatttttaataatatagtttacaatagcaatgtaaatgtaaaaacttagggataaatctgccaaaagatgtaaaagacctgtacactgcaagctacaaaacaatgttgaaacaaatgaaagaagacataaatagagagataactagaggtaatggttcagaagacttaatattggcaaaatgtcaattttccttaaattgatctatagattcgttgcactcccagtgaaaattgtgaaggctttctgtatgttgtggaaactgatacattgattataaaattcatatggaaagaccaaggacctagaatagccaaagcaaatttgaaaaaaaagaacaaaattggaggacaaagaatactttaagatttatcataaagctacagtatggaagatagtggggtatcagtgtcaagatagattaatggaacagtatagacacttcaaaaataaacccatgcatgaacaattaatttttggcacaggcaaatttcacggaggaataatagtatgttcaataaatggtgctggaaaatctggatattcatgtgcaaatgatagatttcagcttatactttacaacataaacaaagatgaatataaaatggaccatagacttaaatgtgcaacctacagctataacatttctggaagaaaacacagaggaaaacctttgtgatcttcagctaggcaaaaattatttatataacagcagtgaaaacacaatttataaacaattgataaactgtactttatcaatattaaaaacttctgtagctcaaaaggcattattaaaagaatgaagacacaggctacacactgggagacaatatttgccaatcatgtaccttgtaaaaaagttttattctgtatatacaaagaacagttaaaattaaataataaaaaagaacaatccaattaaaaatggacaaaagatttgaacagatatgtcactagagaagatatacagatagcaaatatgcacataaaatatgctcaacatcagaattaattagggaaattcatattaaaactgtaatatgatactactacttacttttagaatggttagaaattaaaagactgaccatcacaagaattggcaaagaagaacaccaacactcacactttgctggtgggaatggagaaatggtgcaaccactttggaaaacagtctggcagtttcttaaatattaaacacacacctatcatattgttcacacactcctcttctgggtattcatttacacaatagaaatgaaagcatatatccttacaaagactcatttacaaattttcattgcttcattatttatttgtaatagccgaaagctggaaacaatccttacatgtatcaagtggtgaataaactgtaatgttttcatacaatagaatattgttcaacaatacaaagagaaaattattgatatatgctgcaacatgaataaatctcaaaataattatgctgaatgaaagatgccagattaaaaagtatatactgtattataccattgtattaaattccagaaaatgtaaaataaactatggtgagaaaaggaagatgaatggctgtctggagatgggggttggaggtacatatggagtaggagggagggattataaagaagaatgaggaaaatttgaggaggatattgatattcattatctagattgtggtgatgtttcaaaggtacatacatgaaatctcatcaagttatacattttaaatgtgtataacttattgcatgccaataataagtcaatacatcagtcaaaaaactaaaaaagttcactttatattaaggaatatgcatagtaaaatctttaaagaaggataccaataactagttattttgaatggtggggggtaaatgatttattttttgtataacattagaaattacttttataattattaaaattaaatgaaaataatttcagtactatctagtcgaaaatatattctttttgattgtgtggctacaggcaaatgcattataactaacaacaccatcatcaataattagatcatgcattcattcattcaaaaaggaattgaggggagttttgacagatgaactagatttaactcatcagtgttggggatggaaaggaagtgaataaaatagagaagggttttttgagcatagaatgagagcattagcaaatgcacaaagcaagaaatggactggtttcggtgggacaaataattggttggatattaatataaggtaacatttgagacgagtggtaatgggagagaaaggcataaaccaattcaaggtcttgcctctatatcttgtccacttttgttctcccttgtttcctttttttctctctgctcctcttcctcccttcctctcttcttccctttctcttctctccctttgtcatcttaggttttttgcatgctagggaaattccttgtgtttgtttacaacctgaataattcaattttctgctacatcctatctgctgtttactgtctcccacaaagtatctaactatatatttctctctctctctatattcagttctttatattcttagatttatggtctcatgacagctttggtctagtgttatagacccaaatggcccctagaatattctcgagaatgcaaatcaagtacttccaaattaatttcctttttctaaattacatttactctctttcacaagaagttaccccttgaatattcaggaaattgattacctcctttttttgaactaaagaatagttttctttgctatttcagcattgcagaagcagagctgttctctcagtattagttttatttaataagtcacattggattatgctggagtttgatatagatctctcctcaaatattttataggaggatctctaagatcagaataaaagaagcaaaaggaaaccctagtagtacaattttagcagtttacatgtggcgtttgcagtttacagtttccttggagaagtagtgtagtggaacaggtctatacccatagcaagagatgttgttattttatttcagtatcactaatatgatgctccccattatggctaattctcatgtgtgtgtgtgattaagagcaaactttgagaagttctcatatgcaggtttactaaggaggaaggtaatcaaactcatgcttatccaaaagattcttacgtggttttgaccttgagttcttgtttctctgggataggggatttctccagtgtttactggtgcctctgtccgatctctggctatcagagagttctaaatattttactttggcatattccattcctgtttctcagaactgctaaaatttttgcagtttgaatatttttatgagactttctaaagggtaaataacacaatttttgactctatgacatatcagtaagttttttaattccatagaatctttaaatgccttatgcaaatgaaaaagtaaaaggtattcaatccaataccctcactttataaacagggataatgagtccaaaatagatgatttcctataatttacacaagtaaatagtgggtagaaaagctcagagaagactccaggtctcctgatgtcctatgcatatgtattttcaccacaccatgctgtagcatgatgagttttttcctcaaatttaaaaacagaaatgactaaatgactagaataaataaataaaacatgagcagtggacagttttactggagcccaagggctctaaagaggaaagagccagcctcagacctctgtttccttgaactaatttgtttttgaaaatggtccaccctaatcatagtaatcctcatcacacataataaaatcacattttatgtggtgtttcaggccaaatgaatcccccaaaaatgcttttcagagctaataccaaagtccctcaatcagatgatgccgttacgaaattaaataattaaactacagaactaaaatataaaagggtaagagggaacgtggaaaatgatcattctgaaacaagatcaagagtcaatgaggcagagaaacatgagtcagatccagatggcagccacccactaatcctcagcacactcgtgcctgcctgtcatctcttggtagccgtgggtgttacagctccagtttgccacagccacaagctggtgtacacattccttaagacagaaagagataaagtgttataatgtcttattgatagagatgtgatttccaagaaatgcaaagaaaattgcttttaaaaaatttaatttgctgatttttctctccattgttgggagaacccaaatattgacttcttaaattttgtttgtagtggagacaaatgttcattccaagtagcatcctagtagtagtctttttctcattagggttgcagtgaaggctgaaatgagttcattgagtaattagtcataaggtccatagtaattctgtctgttaaagcagaagtataagagtgtatattggagggcaattgttaaaaggcttttgattttccatggacttttatacacgatctattccttatttcttttttctttctttttttttttttttgtctcaagagggcaaacagcttaaaaatggagtcttaaaatcatttcctgaatttgaatgttggcctgcctggctaggttggggaagttctcctggataacatcctgcagagtgttttccaacttggttccattctccccgtcactttcaggtacacaaatcaaacgtagatttggtcttttcacatagtcccatatttcttggaggctttgttcatttcttttactcctttttctctaaccttgaaaatggccatactgcccaaggtaatttatagattcaatgccatcctcatcaagctaccaatgactttcttcacagaattggaaaaaactactttaaagttcatatggaaccaaaaaagagcccgcattgccaagacaatcctaagccaaaagaacagaactggaggcatcaagctacctgacttgaaactatactacaaggctacagccaaaattgacaaatgggatctaattaaagagcttctgcacagcaaaagaaactaccatcagagtgaacaggcaacctacagaatgggagaaaatgtttgcagtctactcatctgaaagggctaatatccaccatcacaaagaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatacaaatcaaaaccacaatgagataccatctcacaccagttagaatggcgatcattaaaaagtcagggaacaacaggtgctggagaggatgtggcaaaataagaacactcttacactgttggtggcactgtaaactagttcaaccattgtggaagatagtgtggtgattcctcaaggatctagaactagaaataccatttgacccagccatcccattactggatatatacccaaaggattataaatcatgctgctataaagacacatgcacacgtatgtttattgcggcactattcacaatagcaaagacttggaaccaacccaaatgtccatcaatgatagactggattaagaaaacgtgggacatatataccacggaatactatgcagccataaaaaaggatgacttcatgtcctttgtaaggacatggatgaagctggaaaccatcattctcagcaaactatctcaaggacaaaaaaccaaacactgcatgttcccgctcataggtgggaattgaacaatgagaacacttggacacacgaaggggaacatcacacactggggcctgtcgtggggtggggggctgggggagggatagcattaggagatatacctaatgtaaatgacgagttaatgggtgcagcacaccaacatggcacatgtatacatatgtaactaacctgcacgttgtgcacatgtaccctggaacttagagtataatttaaaaaaatcgtttccagtttcttaaaaaggggattctaaaataaaaattttttttctctctcaagttcagcttttgtttttgaaaattaccttttaagtagttcctatagggtgggatttcatcactagatctggtttatgggtgtccaaaacttgaacaattgaattcattcaaatctttgggagaaggtgtatttgctgtcccccaaaatgggtttgaaaatatcacgcgttctgttcttacttttaagtgagagctgaatgatgagaacacatggacacattgcggggaacaacaggcgctgggacttgcagggggcggggcatggggagggagggtatcaggataaatagctaatgtatgctggacttaatacctaggtgatgggttgatctgtgcagcacaggtttacctgtgtaacaaacctgcatatcttgcacatgtatcccggaacttaaaataaaagttgaagaaatcaaaaagagaaaatgttatgcattccaacacaagtctctggacctcacgtcctgatcagtaaacgtgaacaatggagaaatcaatgtcagtgtaaagattgtttgttcttttgtgctatggatgctccaggcctttcaagccaccatttcaagtgtagtgttaaacgtgagggcaaacctgctgcaggcctgtcaaaatgcttgctatgggagtgctgttttattctcgagagccaggctgacacggagccctctggctgccacaaaggcctcttgttggtaaatctcacagagggtatcattactttcaagaatttgatccatcgatatcaataaaaatggagcatcagttagcaaccccaaatgtgtcagctctttttatgtacattctcttatttaattttcacatcactgtgaagttggcttttatgctgctgttttacaaatgaggaaacagagcctgagagaaatttggtaacatgcacaaggtcataccagaaatgaagttcaagacaaaatgtgactctaaattccacactctcttcattatacaacacacactggtttttcaagtcatccagccccaggctatgcttatttccattaataatttgaggacattagtctattatttatactaacgttatagcaaacaaagttaaagcatttgtaactgcttcttcgtttttgtgtttaagcaaaaacatccaaactatgctgcaaacgcacacattggaatgaaaaccaacacacacccccatccacaaatcagttaacaagattgtacatagtatcagcaattaaaaaaggatatgggagaaggaaagacattgctttacattgttacaggctgatttctttacgaggttttttaaagcggaagatccctgcttcctttttcaaatgaattctaatgaaattccaaaatacaacacagataagagccgccttgttggaagctatagttaaaacttcagagttctgacttgaaacttctctgcctcatcaccttctctgggattccaggacttgaaagaagatgtattgaaagcccctcaaactattgaaaataacattaggtcagaagccatggatttgggttcaagagtgggctccctctctttcattgaccctaagcaactttcttaatgctgctgagcctcaatttttacaccttaaaaacaggtataatagtgcttgtcctatggagctgtggtgagattgaagtggtatgatgcatatcagggcccagaacaatggattgaatttaacaagttttaataatgaatactatccttcatccctcaagaggccttctctaaactgtccagatgatatacaggtcacatgtgactatgactttcactgctcaaccaatgcactatcccaaggtgtagcaaatcctgtcctttggttggcaaatatagctatctgtattgacatttgaagtcaacatcttccctaaggcttgctcaaaacgctgcttccttttacgttgctttatttccctgcaacctcaggcattcagggttggaaattaagcaaagcatcatccacatgcatttcttcaaggcatttctaatagatacagtacagaaaggcccagattaggaaaagatacaagtacttctaagataatttaaagttttttcgtctctcaaatgataccaatgcttaatagtagctactgaattagcttgggcacatggcatgaatgtgtacacagttatcatattgtttctgtgaatcttctgtgaaactgaggaagttacatttcctgattcagaggttgtaattaaaatactgtatggttgacaaaaaggggaaattttagtaactgatctgttggccccccacactatggagctgatcctgtcagttcttgttaatgatcatgctttctttagtactgagtaatgtgttaggaataaaaagtttcccccagctcttagatgtgaaaaaatgagtttgaaatcatcttctttatttctgtaaagattttaatggagctatagaaaacataaaaaaaaagactgttgataatcttgtccaaattcatattagactttgctcatctatctacagacttggcagacgtaactaatatagattttaacaaattctattcaggctataaactttctgctaaaggaaataaaaagatattacctgctaaatgtcctgcacatcttgaacacaacagtgctgaaaaggggtgtgatttgcttacttgtggatcgaggctttcataataaaagttcctggtcactttgaagtttcctcagaacatgcagaagcaattaacaacatgtttgactttataaaaatgggaagtgatagcttcttagacatgtgcctacaagatggtacatcttgatatactgttgctggccatagaaaagatttttaatctttggcctgcagtaaactattttcaaagtgtgagacaagaagaaatctcttgtaatttggaaatatgttgaggatgagaatgggggaaaaagagtactgtaaaacagatttatatgctgtttctctgaagctgtttgatctttgaagagacattaagtatcctagaaaaggatgaattaactgtacatgaatagttttaagttgtgacaattatatggaaaaaagcctcaatttttggaaataagacagcttcagaattgagaaaatgtcaatgaaaagggcaaccaaattaaacagaactttctcaatttccttactaaatttgtaatttatttagagtgcaatgttaatttcacaagtttagatgacttctgtgctttaaaaccattttccctggggtaggttaaacttcgtgttttaaaaccatgtccattttacatctggagaacttatgcacacatttaaagatgcaaaagacctgatggacaggcccaagctggtctgtggtaacaagcctgtagacacaaagtgggtggagatttggggatgaaaactaatcctacatatctaaaagcctgctgttgccagtaaataaaatattaagtattccattgttatagtttgatatttgacccctcgaaatctcatgttgaaatcggatccccagtgttggaggtggggcctggtaggaggcatttagattatgggggtggatccctcttgaacatcttggtgctctgctcatggtaacgagttggttctcattccattagttcccatgagagctggttgttaaaaagagcctggcacttccctcctctctctctctttctcttgctgcttctctcagcatggtgatctctgcacattctggctccccttcacctctgccatgagaggaagcttctggaagccctcaccagaagcagatgccggtgctgtgcttctgcagaaccatgagcaaaatcaacctcttttctgtgtaaattacccagtctcacgtcttcctttatagcaacacacaaataggctaagatgtagaagcgcaaatgcttttgtagagagcatgtatatcaccttgacattaccatgctggactgacaccaggtacccatgtaacataggctcaatgagagcagagctgcaagacaaagtaatgttacatttgctatatagttttgcctacataaaagaaggatgtcctaaagggtgcaggcatttgaaagaagtatcattagagaagtaaacagaaagattataattttcctatgtctcaaaggactaaaagaaacttgtttttcattgcatagtggtaataagacatttttaattagttctatttatgttctcttttttaaaagtattatgcaccttaaaaatacatattaatatagcatgatgaatatatagcatctctttaatatccaagagaatttaaaaagatttaaataaattgctctgttaaagaatagaaaaaattgatacaattatcattacatttttctcacatatatttgtttatacctactattaattactactaactaccacttttagtcttattttgttgtttaaatattagcatttatataatagaaagtaaatagtaagtaataatatatgatttcaagtaaacatctattcttcatattttatgttaaagtaataaaatgtctataattttttaaaaattattatttttgtctgtttggtacagccgtgtcttggattgactttctaaaatgttggcaattctccctaggtaaatgcatcataaccagctccaggcccacctgggttccctcctcctcttcctatagaatgcataaaagcagatataactgactcaggctgtgtaaagacaaacataacttacaatacccttacctccaaccgaacatctgaggggaagctaataaggtatcaaagaacatggacacagactaacagataatttaacgacatttatgtagaatgaataaaacacatagaaaggactgtcctagttaacatagaaggtaacaatgtaggggcaaaacccctctaaaagatataagcaagacggcgtacaaaagacatgaataatttaagctggggaaaacattacccaagaaacaaatgcaaatttcctacaactgctttgcagtgtagaagaatttcaggatatcatgaattcagtgactcaagatccaaagggtaggatgccaaaacaacagaatgagctggtaagaaagatgcctgaagaagacagaaactgagaacacaggccgggtgtggtggaacacgtctgtaatcccagcactttgggagactgaggcggggggatcacctgaggtcaggagtttgagtccagcctggcaacatggtgaaaccccccctccctactaaaaatacaaaaaaaattagctgggtgtggtggcaggcgcctgtaatcccagctacttgggaggctgaggcaggagaatcacttgaacctgggaggcggaggttgtggtgagccaagattgcaccattgcattccagcctgggcgacaggagcaaaactttgtctcaaaaaaaaaaaaaaaaaaaaaagagagagagagaaattaagagcacaaattctccttttaaatgaaattaacagaatagaagcagaatagatacagcaaaagagttaatttgtgacagagagagcaaaggcttgtaatgatagccctgaatgtagaagaaaaagtcaaagagattaatgcaactagaatgacaataatttataagaagccagggatgatgctgttatcaagaacaactggtctttctgaatagaaagagagagaatgccaaccgttgtgaatgacagaaaactctaccagagtggccttagaaatcctgggtcaggcatccttcacttgcctctgctgtaaatttttctgttatttttaaaatttatatatgttgggaaatcttcctccattattacctaatattgaggaagtaatttattttatttataataacatatgaacacatgggctgcgtgcagtaatcctagagctttaggaggccaaggcaggaagattgaggccaggagtatgagaccaagcctgggcaacatagaccctgtctcttaaaaaaaaaaaaacaaaaaaaaccaaaaaacacaaaaaacacaaaaattagctaggtgtaatggcatgtgcctgtagtaccagctacttaggaggctgaggttggagggtcgcttgagcccaagagttccaggctccagggagttgattgtgccactgtactctgtcctgggtggcagatggagatcctgtctctcccactcctgcacgcccccaatacacacacacccacacacatgcacgcatgcacgtgcacacacacacatgcacacacacacatatataaaaatacatgtacatttataatttataaatttataataaaatgcttttataattttatattaaaaatatagatcattttaatactgtatatataatttttacatataatggagcattttattatatatttatataaatatattacagatattaatgttttcaataatatatagtgaaatataaagtttataaacttatatagtttaaaacatgaatccaataatgcaatgtacatacatatgtgtatgtgcacatgtaaattttgtctatcacatgggccattctaaaaaaaatgataacctgacttgtatcgaggctgtgattaaacagatctggtcatacactaaagctgtctatgcacattgaaagctataaaagtgtttaactcctttgacccagaaatttcactattaaaattcttatttaaaaataaacatttatatgcatgggtatttgtgacaacattgtttctaatgctaaaagattagaaataacttaaaaattgaaccatagtgcctgttcatgaagtaggtagtggtatatatgaaaaatcaaatactattcagtcattaaaaatcagatgtcaggaaaaaatttggaattcataacacaatgctgaaaatataggtgaaaaatgcagatacaggttataaaactttgtatagtatgatcatgactatatggaaatatacacacatatataatcttatttagtgatctgtccattatgcatccattccatttatttctattgaaagcacacataagcaccaaaaagagattttaattttgtacttaatttatttcacatttttcagtcaaaaatatttttaaatattaaaaaaagtattttttagaaaaataaatataactgcagaaatgatagcaccttaatttattagtaaatgtgatcataccagatactgtgatgggtgtcaaaagaatctttgggaaccctcttcaccccagatgggaacagtttccttggttctgtttggagatgtcactgagaggagggtgaatttgccccttatttttgcccagcttccccaaagcattattttttccaagaaacgaaaggaccagatgaaatgctaatggacttgatagagtacaggcacaaagatggagaccaaagaatatgattatggaaatgggagcatgtggtcttttgggtgaagaatttttcacttctttggagactggaatgatgcaatagagcccatttatccatttttctaaattagaaggtggcaaactgaaggtgtcactctggcccacttgtgtctttttctgattttgaccccgcagcccacttgagatgaaaccacctctccactctttgtagctttggcttaatgtcaggcttggggtgcttgagacttgtacacaggcacagagtgggggactgcatctgtgagtctctcattcagggctctggaaagccttgaggagaagtggttggacattggaacaagggatcgtgtttcttaattcagtggagaagaccagtgtgtagagaatggtgtctgaagcattctctcaaggtgtcccctggagaaagtcactcctttagtcaaattttggaggctgttcaaaacctttgaattttggaatattttctacgtttattctaaccaacctcttgtcataaacacaaggctgtttgcattaaacaatcacactgattggaaatgacagagcctctctggcaagcccatcaggccaagagagaggcatagcagagtataaccggggtcagtttctgagtcctgtctctgaaaatgagactgccaggcatgaggcagaatctttgtagagtcatacattctcctgtgaggaattctgtcctgatacttgctcttgactttgccgttttttaatttcttcctttcactcgtactcacatcctgttggaacgactcattttgttctcgttctgctctgggattttcttcggagtgcaaacccagaagtacatctgcactttctcagcgaactcatcgtttggctgggctgctctataattagatttttcaaaaacctctctcctcgtatatcaattattccactcccttaatcatcttcctcagtgttttgcgtgatcctactcatttatcaagatgtctgggtctatgcttaagcatttgcaaagaaagagtgatgcctgctactagagtacagtgtctatgtggagggcgtcttgggatcttttctcccatgtctgttcttttgctttccactatccttgctagatcataacattactttcattttccaatccagaatgctgttccttttaatgtacttcaggatttccatgatgatggttttagaagtagagcattctggaaattgatgctctctgtgtttgtgtgtctgtgtactgggagacctaacttcctgaagcattcaccagttgtgtaacttattttcctacgataacctgggtgatagccaacaggcaagatatatcatgagataaattcctgaccccgtgttgggtagttagtataagagggaagatgggccagtactcaggcacagaacaggtaaccctctgttccaacaggagtgccagagtctgaaaatttacactatggtgatttaatcatagtcccaacctcatcaaactagacctgaataagctagcaaggtcttaggcaaaagacatatgtaaggaaagatatatatttctacaatttgtcatttaggtcttactgtagaacttgatacaaatatactgtctgacaagttctcttccacctgtagacactattttatgatgggtataaattcattcttttattatagtcactaagcatgagtgatttacttcttcaattgatctatgagggtttttaaatgccttattcactcatgtattcactttttcatcatgcatttattgagagcttactataggctgggtattttgtgggtgctggggaaggactgatgagtagaaaaagatatggtctctgtcctgagttttatagatctataggaaagacagatgttaatcataacatcccacaaatccttgtaaaatcatggcgatgataactcctagttgaagggtaccttggtgaagggcatgttgggggtgttctgactggctgaatttgcatatagtcatcctggactaaattagacacacacatacatgtgtgtccttggctgtaactgttctgaaggtgaggtcatgttgtagtgtttatttttcacagggtttggtagtttttattgcatttaacacacagttaacattattttgttaatcagattcagggaataaaaagctccccaaagtaatttttctatcaaaataatgcctagaaaataaaaaagattggatatctattacagcttcttaaaagtctgcaaatcatctggcttgctgggattcccatgtctttagattaaagtgagatttgactccaaatctggtgggaaatccagcatcctgtcactctcagtgttcaccaataaatgtccatatagcattttttattgaggacttttggcaaaacgtggtttaaatggcaactaaaccacagagcaggatagcaaaaatatagatactggctatgcaagattttaaaagtccctcaaatatttcctctcctgggggatttttgcttttttatttatttttttgtttaactcaaggtttgtcatttgcccatatttctaagtctatccaagctctgccgtgggggcgtctttcaacaactattctcttttgttgaggatcataagacttactgaggagaaaataaaaagatttcgtggtcaaataaatttggggagcttcagttcaaatgccataagacattttttaaaaaccataggatatctgatttttagcatactaatatatgttgtacatttttaagaaagtgattttttagtttttttcagagatctactttaaatatttcaaataaattatatcatttatgatgactttggccgcatgtagcatgcattctgacttaaatgatttaagcagaaagaaatcttatttcatgcaactgagttcagatgtaggatggacgtcagggttggttgattcagtggctcagtgatggcatcacaggcttagttttttccatcttcgcctctgccatactcagtgttgattgcatacctagtggtagagggagtgtcctgaaatctacaatagcaatatccttaagaagaggagtggccatttgttcctagagcccttaggtgtgaagaaacttgtctcagaatccccaaatgtactgtttctcatgtatctttggacagaattgggtattagccttattcctacatcaatcaacagcaaggagaaggggtgagctctcctttaagcacctggatacacatggggtgggtaatacctgcacaaaattggagggagttatgtgggattaagtgtcaagtagatcactaacaacgttttctaaagaaatacactgctatggactgaattgtgtcccaccaagtacatatgttgaagccctaacccccaatgttactgtattttaagatggggtctttaggagtaaagttaagtgaggtcataaggatgaaaccttaatcctataggactggtggtcttataagaagagaaagagattttcctttctctctttcctcctctccctgcatatgcgaatgtgcacatgtgcgcgcgcgcgcacacacacacacacacacacacacacacacacacacacacacacacgaaaggccatatgaggacatgctgagaaggcagctaaacgcaagccaggaaaagagaattcaccagaaaccaaccctgccagaccttctagcctctagaactgtgaaaaaacacatttctgttgcttaacccacccagtctctgacattttattatggcagcctgagctgacaaatacagattttggtattgagaagtggggtgctgctgtaacctaaaaatgcagaagcagctttggaactgggtaatgggtggaggctggaggagttttgaggtgcatgccagaaaacgcctaggttgctgtgaagggactgttggttgaaatatggacattaaaggcaattctggtgaggactgaaaaaggaaagaggagagacgcagagaaagcctccacctgcttacagaataagtgcagcgcgatggaaagaacgttggtagaagtaaggacatcaaaagccattctggcaaggaattagatggaaatgagaaacaagttattggaaactggaggaaaagccatcgttgttatgaagtggcaaataacttgggtgttctagtgttttgtggaaagtagaactggcaggcactaaaattggataattacctgaggcgatttctaagcaaaatgttgaagatgtggctatgttcttcctgaatgcttagagaaaattctagagaagaaagaaattgacaaaggaattgttaagcaaaaaggaactagagcttgaaaatttagtaaattctcagcctatccatgttgcaaaaagtgaggaagcatgttctaaagagaacactaagagtatggctggactattacttgataaagagataatgagattatatgggcagaaaacagcttggactgaagggaatagagcaaaaggaactaagtgaagaaagactgtcagattcttggatgcttcaggacagaacaacagagctatttcactgaaaacatgagctattctttaaaaaaaaaaaaggaaagactccaaagatgattcagagatgatcaaggctaccactcacatcacagcccagagtatacaggcccagggtgcaaggttgggtgaggtcactgccttggtttcaagaggccaagctatctcttcctggagtgttggggcaggatctctaactgacagagtcatgggggtgacagagcattgaactagaaaggattatgctccagccttaaaatctaacagaatttgccttgctaggtttggaacatgcttgggacttgtcatctctttctttggtctgatttctcacttttggaatgggaatgcctgtcttatacctgtcctaatattgtattttcaatgcacataagttttctggtctcatgagctcacagctatggagaaatttgcctgagaatagattgtattctgaatacaattgtattcgaccgtacttgacttagacaataattagatgagaatttggacttgagattttagtgctgatgctaaaatgaggtgagacttttgaagctgttgggatggagtggatgtactttgcaagagagaaagatattaatttcaaggggtcagaggcagaatgctagagccttaactgagtccccctgaaattcatatgttgatgccctaatccccaatgtgattgaatttggagacagagtctttaggaggtaattaggattaaattagatcataagggtgagatcttaatcctacaggactgatggcctcatgagaagaggaagattttctctctctctctctctctttctgtgtgtgtgtatgtgtgcatgtgttgagggagggccatgtaagaatatagtgagaaagtgctgtctgcaagccaagaagggcgcccttagcagaaactgaccctcccaggccttgatgtgggacttccagcctctagactggtgggaaaataaatttctattgcttaagccacctagtcttgatattttattattattgctgtagaagactaatacctatatcaatgtgataaaaattaaagtaaaacagaagtttctagaaaaaaatgagattcctctctctatgacaattctagccttgaagattgctgctaaaaataatttgtggtgtagttttctagtcgctttaatacttaccaaatgcacgcatatgtttgtgtatgtatacatacattaatcattatacatacatgctttgtttactttttatttttttaacattgatatttacttactgttatacaagttgtgtattaccatttaacaaaatacatagccctatctcattctttataaaggttatatagatagattgtgtagatgtattataattctttcaaccacttcagtatgggagaatgttgcgtgaagtggtttccacacttatctgaacatgaaacatctcatattatatatatatctccaaaatatataattttggacctgctattctagaacttcaggttgtctgtgtctgtttgttgccttaaaagaagatgtaacttcctgaggctctcaagacatttggccatttggccatggcaaaatgtaattggctaatagttctcaaaagccatgataatatagggcactaatgaatacccatgtgctggatggtccccgtctggtcctcgtgcacctgaagtgctaacttcccattctttaggggaccaagtactttgttctttcatttgtgacactgaactgttacggaaattgtgacattactcagcagctgacttatttcatcttggatgaactctccttctagctacgtggcttgaattgagtaaatctgactaatgaatcaacaggcaggattttggcaacatgaaagattctggcctccataaaagtttttaaaatttgcgtagtgtttataaggaaaattatttctcataatttatattacttgaatctaattttatgtatcaacaaatactctgaaagtgacaaaaagtcaccttagtcaagccatttaatccctaaagccatccaatcctattaatggggttgtgaagataaacatgggtgattctaacatgcctgtgagtttgcacaactgtcctgtttgcaagagccaaggtattcttgtgtttaccattggggattgaattgatttacaacataaagattattctgaaaatccaatttccatgcaaacgctgttaattgttatacacgtgtctcagtttgttgactcagttgtttgaaggtccagagctgtattttggaagatttgtcaatttaattttttaaaattatgacaatttaatttttcttttattcatatttaaagcctcatttaggcttggatttattttaggtgacagcacatatacataaaaaaagaaaaagaaccagtgtcattaaattgatggatcagagacttaaaatttttttagtgagcttcctttcctgatttcaacaaattataagaaagaagatctttcccaagtccacttaatctttagcacctcatttatgccatctatggcatttttctgtacaacagtgacttacaaattatcacagatttcagatactggaagctgagatgtttcccatgctttattgtttaaaggtgtttattttatagcactttttagttgcattatatcctactctagagtaatagacccctaccccccccccccttttttttttgctcccatcatggtgttgttttaagcaatcatgaatcctttttctttttctttttttttttgagatggagtctcgctcttgtcacccaggctggagtgcaatggcgcgatctcggctcactgcaacctctgcctcccaggttcaagcaattctcctgcttcagccgcctgagtaactgggattataggcacctgccaccacgcccggctaattgttgtatttcagtagagatgaggtttcaccaggttggccaggctggtctccaactcctgacctcaggtgatccacttgtctcggcctccgaaattgttaggattacaggtgtgagccactgtgcctggcgaggaatcatgaattctttaaattggaaaataaaattgtcttcttattcaaactcctatccaaatgttttcatacagtaaaagtacaaggcatatagtaatagtataattacaattatactaataatcataagtttattaaagtatgtattcaatgatacacatgcataaatatgtataattatatatgataaatagtcttgtctattattaccattatactctacttggttaatataattttaataatgaataggaatagtccaggctaccagtgttttaaaacgactgtgtacttatctatagatcaatcaagacctaggaaagataatgggaagttctatgtaggatataatgacatttttcaaatcttctccatctctgtacccttaagaagaaaaagaagtttcttgcagtttcatatttaggaaggcaaccttgggtaggatgttgattacagatatcatttgactatcattcttgtcttttaatctagatatagcaagcacagtgtcctgaagccatgtctgagacatttgaaggcagagtaggagctatcttgaatagaaaatgcctttcagcccacagagatgatgttatcacaaaacactgtgactcaatgggttgacagatcctttccctctcaacacagagtctatgatgttgttttcactgagaaagcttagtcaagagattaggtgatagcagctagcatttacctctacctcaccatggtgcaaaacctggcagctggagggaggagaggggagcacaatggagcagtgcagcattaaagactaatgtgcccaattctcaggaccccttgggaatctagggcatccttttcattgacaaaaatcatttatgtggagcttcagtaactgaatctgtcatgtcagctacttcagtaggccgcacggatttaaatgggttagaagttccttctctttaaagggcctttataggcaactcacacaaggacagataggtttgggcacatgtagggggcggtgctggcagacaaagaaggccaatttgagttcatccatttaaccaattaggaaagttcagcaacaagtaaaccctgtgtggccaggcatgggagcgcatgcctgtaatcctgtaatcccagcactttgggagaccaagtgggtggatcacttgagcttaggagttcgacaccagcctggccaacatggtgaaaccccatctctactaaaaatacaaaaattagcaaggcatggtggtgtgcgcctgtaatcccagctactctgggggctgaggcaggagaatcccttgaacccaggagggagaggttgcagtgagccaagactgtgccactacacttcagcctgggtgacagagtgagactctgtctgaaaaaacaaaacaaaaacaggtaaacctgtgttaggcacaggaggaaggggctctgtcatatgaccctattttctcacttcttccttttgtctatttttttctctctcaattatttgtaagaatatccttgtgctatagagatcagaagacctgcactgaaaaagttaatcttcttaagtctcagtttcttcatagtaaaatgagacagcctcagatttgttgtaaaaacaattgaaatgagtgaataaggaccttgacattgcacctgccacattgcaagtactcagtggattccactgactaacaatgctttgtcaaacagggcagaagctttcattatgttgggggtaatgttttataatccttaaaataccaaagtttcaatatttttatttcctataatatttctgagaatccagaaaggagctgggtcaccatactggaaaaattgccctccatctcacccatatgaaacttgtggaaatttttgattcagataagaactgtagtggcttatcacaggcaaagccctggtgctaagtgcttctagagttatcagggtccatccctgctctggaggggtttaagattgcataaggaggctgaggcaattgcacaaattactatttaataatcaccataaggacaggcacagtggctcatgcctgtaattctagctacttgagaggctgaggctggaggattgcatgagcccaggagttcaaggctgcagtgagctgtgatcacaccactgcactccagcctgagtgacaaaaagaaatctgtctctgaaaataaaaagaataatgatagtgataatgatgatgatgatgatgatgatgctaatcaccataaaagttactgagatgctgaggggaatccaaaagttgggagttcacatctggatagaggatcaggaaatgcttcatggtacagattcgtttttgaaaatctaagatcaacacattttcaagagcctgagagcttgatagcaattttaaaatgttatgcttacgttttaaagatagtcacaaatgtgctaccctaccaaaaatatatagaaaacttttcattgataacttatagctgaaaatatttttataaggctagtttctaaggtcattgtttctgaaactggcaacctaaatattgtttgtctttataaatacacagtatctgtgtatttctcaagtataagaaactgtggtgtttcagatgaggagtggatagttggatagaattttgactcacaggctttttgagtttctcactgacagattgactcctacttggacttcagcatctttgctacctgaccacagctatttttggactgtggctacctttactctgtttaatctgtcaatagacttcctttgtgtcttttctttcaaaaatttgttgaggtatttgtttgactggtgacttccccttgccattacctccattgttacggagttactcatcttcgtatttccattctgaaattaatggggtattgtgggaaaggaaatgaatttatgttactattttactttgaaggagaagtccctgtctctcatcttattcattcattctttatttatttatgcaaagacttgattaggatccaatagatgtgatgattcaataattcaaaaggaaaaagcaacaaaactgaaaataaaataaaaatttatttatgttgcactcttggcaagatattacactttacatgacactcctagataaagagtgaaggatgagacttatgatggatgaggagtctgggacaatagccaagatctttatagggaggctgaaaaaagcaggtggactgtacctgtggctctggaagcctcactaggaagagctctaagcttgtcaagccacttagaggaatcctcattctatgctttctgtgtcccaatactcagtggagccaagaaaactacctagcaccatattctcctgccaactcagtaccttcattgccccctgtccttcctcacaccattccagctcactcctggtattctttaatttttactcagtattatttttagagcaattttaagattgcagcaacattgagcagaagatactgggatttcccatataccccttaccctgcacatgcagagccccctacctgttatctgtgtctcccatcagagtggtgcattgatcccttcccttaccttcccttcctttcccttccccttccccttccccttccccttccccttccttccttccttttttctcttctcttctctttgcttgcttgctctttcatttgttcattcattggttcgtttagttttgtttttttgagacggagtctcactctatcacccaggctggagtgcagtggtgcaatcttggctcactacaacctctgcttcctgggttcaagcaattctcctgcctcagcctcccgagtagctgggactacaggcgtgcaccaccatgcccagctaatttttgcgtttttagtagagatggtgtttcgccatgttggccagcctggtcttgaactcctgacctcaggtgatccacctgccttggcctctcaaagttctgggactacaggtatgagccaccgtgcccagcctacaatttctgaatctacattggcacttcattgtcacccaaagtccatagtttacatcagagctgacttttggtgttgtacattctctgggtttggagaaatttatagtgatatgaatctaccattatagtatcatacagagtaatttcactgctctaaaaatcctctgtgcttcaacaattcactgtcaaacagggcagaaccttttattatgttgggggtaatgtcatccttttcttcctttaaccccaggcaaccactgattttttcatagatttgccttttccaaaatgtcatttagttggaatcacacatacgtagctttttcagattggctgcattcacttagcaatatgcacttaagggttctctgtgtcttttcatggcttgatagctcatttccttttagttgtgaataacattccattgtcaggatgtagcaaagtttatttattcatttacctactgaaggaaatcttagttgcttccaagttctggcaattatgaataaaactgctgtaaacatccatgtgcagattttcatgtggagatgagtttttaacccatttaggtaaatacgaaggagcacaattgctggattgtataataaaagtttgtttagctttgtaagaagctgtcaaactgtcttccaaagtggttgttaccgttttgcattcgcatcagcaatgagtgagaattcctgttgctccatcctcaccattcgtcggtattgtcagtgatctggattgtagtcattgtaataggtatgtattggtatttcattgtggttctgatttgcatttccttgatgacatatgctgtgaagcatctttccctatgctttgacatctgtatgtcttcttgataaggtgtctgttagggtttttagcttattttaaaaatcagcctgcttgttttcttgctgttgagtttttaatttaattttattttgattatactttaagttctagggtacatgggcacaacgtgtggctttgttacattggtatacatgtgccatgttggtttgctgcacctattaactcgtcatttacattaggtatttctcctaatgctatccctccccctgcccgctaccccacgacagtcctctgtgtgatgttccctgccctgtgtccaagtgttctcattgttcgattctgacatatgagtgagaacatgcagtgtttgggacagtttgctcagaatgatggtttccagcttcatccatgtccctataaaggacatgaactcatcctttttttatggctgcatagtattccatagtgtatatttgccacattttcttaatccagtctatcatcattggacatttgggttggttccacgtttttggtattgtgaataatgttgcattaaacatacatgtgcatgtatcttcatagtagcatgatttataattctttgggtatatacccagtgataggatggctgggtcaaatggtacttctagttctagatccttgaggaattgccatactgtcttccaaaatggttgaactagtttacactcccaccaacagtgagaaagtgttcctatttctccacatcctccccagcatctgttgtttcctgactttttaatgatcaccattctaactggtgtgagatggtatctcattgtagttttgatttgcatttctctgatggccagtgatgatgagcattttttcatgtgtcttttggctgcataaatgtcttcttttgagaaatgtcttttcatatcctctcccactttgtgatgggattgtttgattttttccttgtaaatttaagttctttgtagattgtggatattagccctttgtcagatgggtagattgcaaaaattttctcccattctgtaggttgcctgttcactctgatggtagtttcttttgctgtgcagaagctctatagtttcattagatcccatgtgtctattttggcatttgttgccattgcttttggtgttttagttatgaagtccttgtctatgcctgtgtcctgattggtattgcctaagttttcttctagggtttttatggttttatgtctaacatttaagtctttaatccatcttgaattaatttttgtataagatatagggaagggatccagtttcagctttgtacatatggctagccagttttcccagcaccatttattaaatagggaatcctttccccgtttcttgtttttgtcaggtttgtcaaagatcagattattgtagatgtgtggtgttatttctgagggctctgttctgttccattggtctatctctctgttttggtaccagtatcatgctgttttggttactgtagcttgtagtatagtttgaagtcaggcagcatgatgcctccagctttgttctttttgcttaggattgtcttggcaatgcaggctctttttcggttccatatgaactttaaaaagtagatttttccaattctgtgaagaaaatcattggtagcttgatggggatggcattgaatctataaattaccttgggcagtatagccattttcacgatattgattcttcttatccatgagcctggaatgttcttccatttgtttgtgtcctcttttatctcgttgagcagtggtttgtagttctccttgaagagatccttcacatcccttgtaagttggattcctaggtattttattctgtttgtaacaattatgaatgggagttcactcatgatttggctctctgtttgtctgttattggtgtataggaatgcttgtgatttttgcacatcgattttgtttcctgagactttgctgaagttgcttatcagcttaaagatattttgggctgagacaatggggttttctaaatatacaattgtgtcatctgcaaacagggaaaatttgacttcctcttttcctaattgaataccctttatttctttctcttgcctgattgccctgaccagaacttccaacactatgttgaataggagtggtgagagaggacatccctgtcttgtgccacttttcaaagggaatgcttccagttttttgcccattcagtatgatattggctgagggtttgtcataaacagctctgattattttgagatacgtcccatcaatacttagtttattgagagtttttttttttagcatgaaaggctgttgaattttgttgaaggccttttctgcaactattgagataatcatgaggtttttgtcattggttctgtttatgtgatggattatgtttattgatttgcatatgttgaaccagccttgcatcccaggaatgaagcctacttgatcatggtggataagctttttgatgtgctgctggattcggtttgccagtaatttattgaggatttttgcatcgatgttcatcagggatattggtctaaaattctctttttttgttgtgtctctgccaggctttgttatcaggatgatgctgacctcataaaatgagttagagaggattgcccctttttctattgattggaatagtttcagaatgaatgataccagctcctctttgtacctctggtagaatttggctgtgaatccatctggtcctggactttttggattggtaggctattaattattgcctcaatttcagagcctgttattggtctattcagagattcagcttcttcctgatttagtcttgggagggtgcatatgtccaggaatttatccatttcttctagattttctagtttatttgtgtagaggtgtttatagtattctgtgacggtagtttgtatttctgtgggattggtggtgatatcccctttatcattttttattgtgtctatttgattcttctctcttttcttctttattagtcttgctagtagtctatcaattatgttgatgttttcaaaaaaacagctcctggattcattgattttttgaagggttttttgtgtctctatctccttcggttctgctctgatcttagttatttcttgccttatgctagcttttgaatttgtttgctcttctctacttcttttaattgtgatgttagggtgtcgattttagatctttcctgctttctcttgtgggcatttagtgctacaaatttccctctacagactgctttaaatgtgtcccagagattatggtatgttgtgtctttgttctcgttagtttcaaagaacatctttatttctgccttcatttcattatgtacccagtagtcattcaggagcaggttgttcagtttccatggagttgtgtggttttgagtgagtttcttaatcctgagttttaatatgattgcactgtggtctgagagacagtttgttgtgatttctgttcttttacattgactgaggagtgctttacttccaattatgtggtctattttagaataagtgtgatgtggtgctgagaaaaatgtatattttgttgacttggggtggagagttctgtagatgtctattaggtctgcttggtgcagagctgagtttaagtcctggatacccttgttaaccttctgtctcgttgatctgtctaatattgacagtggagtgttaaagtctcccattattattgtgtgggagtctaagtctctttgtaggtctctgaggacttgctttatgaatctgggtgctcctctattgggtgcatatatatttaggatagttagctcttcttgtattgatccctttaccattatgcaatggccttctttgtctcttttgatctttgttggtttaaagtctgatttatcagacactaagattgcaatccctgctttttttttgctttccgtttgcttggtagatcttcttccatccctttattttgagcctgtgtgtgtctctgcatgtgagatgggtctcctgaatacagcacattgataggtcttgactctttatccaatttgccagtctgtgtcttttaattggggcatttagcccatttacatttaattttaatattgttatgtgtgaattttatcctgtcattatgacgttagctggttattttgcccattagttgatgcagtttcttcctagcattgatggtctttacaatttggcatgtttttgcagtggctggaactgattgttcctttccatgtttagtgcttccttcaggagctcttgtaaggcaggcctggtggtgacaaaatctctcagcatttacttgtctgtaaaggattttatttctccttcacttatgaagcttagtttggccggatatgaaattctgggttgaaaattcttttctttaagaatgttgaatattggcctccactctcttctggcttgtagagtttctgccaggagatccgctgttagtctgatgggcttccctttgtgggtaacttgacctttctctctggctgcccttaacattttttccttcattttaaccttggcgaacctgacaattatgtgtcttggggttgctcttctcgaggagtatctttgtggtgttctctgtatttcctgaatttgaatgttggcctcccttgctaggttggggaaattctcctggataatatcctgaagagtgttttccaacttggtttcattctccctgtcactttcaggtacaccaatcaaatgtatatttggtctttcccatagtcccatatttcttggaggctttgttcgtcgctttttactcttttttctctaaacttctcctcttgctttagttcattaatttgatctttaatcactgataccctttcttccacttgatctaatcagctattgaagcttgagcttgtgtcacgtagttcttgtgccatggttttcagctccatcaggtcatttgaggttttctctacactgtttattttagttagccattcgtctaatcttttttcaaggtttttagcttccttgagatgggttcgaacatcctcctttagctcagggaagtttgttattactgaccttctgaagcctgcttctgtgagctcgtcagtgtcattctccgtccaggtttgttccgttgttggtgaggagctgcaatcctttgaaggagaaaaggcactctggtttttagaattttcagcttttctgctctggtttctccccttctttgtggttttttctacctttggtctttgatgctggtgacctacagatagggttttggtgtggatgtccttttgttgatgttgatgctattcctttctgtttgttagttttccttctaagagtcaggtccctaagcttcaggtctgttggagtttgctggaggtccactccagaccctgtttgtctgggtatcaccagcggaggctgcagaacagcaaatattgcattacagcaaatattgctgcctgttccttcctctggaaactttgtcccataggggcacccacctatatgaggtgtcagttggcccctactgggaggtgtctcccagttaggctacacaggggtcagggatccacttgaggaggcagtttgtccattctcagagctcaaacactgttctggaagaaccaccgctctcttcagagctgtcagacagggacatttaagtctgcagaagtttttgctgccttttgttcagctacgccctgcccccagagctggggtctacagaggcagcaggccttgcagcgctgcggtgagctccacccagttcaagcttccccagccactttgtttacccactcaagcctcagcaatggcgaatgcccctcctcctgcaaggctgctacctcacaggtcgatctcagactgctgtgctagcagtgagcaaggatctgtgggtatgggacttgccgagccaggcatgggatataatctcctggtgtgccatttgctaagaacattggaaaagcacagtattttggtgggagcgtccgaattttccaggtacagggcatcacggcttccctttgctaggaaagggaaatcccctgaccccttgcacttcctgggtgaggagatgcctcaccctgcttcagttcaccctccatgggctatacccactgtcccaccagtcccaatgagatgaaccaggcacctcagttggaaatgcagaaatcaccgtcttctgtgttgttcacgctgggaactgcagactagagctgttcctattcggccatcttggaacagaatcctgttgagttttaagagttgtctcctggaattcttgtttattttctctttaaaaaaaggcttgtctttgtagtacaccttctatgtggtttctagaagtagtgtggagttaacattgaggtatatttaagtttagcagacaactgttgcaatctattcaatgattagtttatttactcaccaaacatatatttataaattactgtatagcaggtgctatgataagtgctgagattttaaagattatatttgctgtcctcaaagagcttctagactaatgtgaagtcagatacataaatacgcaatttccatgttaccgtaaacaatgttataataaagaaaattagaaagtgtgatgagaactcagagaaggaagaactttatggagtctggaactcaggaagcgggggagctggaattgagctggatgatataaggtgagtagataggggaggaaaagtttgctagctgggaaagggccaaaggggaaaaggctttctaaagaatgagagaaattccctttcaaccttggggtgaaatgcaagaacatgtgtgttaatgagaatttcaggtagttcagcatgcctggagttctctgagagattatagcccatgttgaacttcattggtactaaatcccatcctttaaagaagtgggattgacagttatttttattttttattttttgggacagagtctcactctgttgcccaggctggagtgcaatggcgtgatcttggcacactgcaacctcagcctcccaggttcaagcgattcttctgcctcagcctcccaagtagctgggattataggtgtataccaccatgcctggctaatttttgtatttttagtagagacaggatttcaccatgttggccaggctggtttcgaactgttgacctcaggtgatccacccgcctcggcctcccaaagtgctgggattacaggcatgggccactgtacctggacgacagttttattgaagtcttcccatatcatctgagttttaatgacgatcttaatttctaaacactacaaggattctgggaatcataaatcctgtcaatcaaggagtgatcaccaaatcattgcaaggctttgtgatatgtacaaaaatgaataactgcccttactgtctggaaccgcagaccttagttaggaaagagttcctcaaaactaaaagatctctttttttaggtgatagtccttagttttatttaggaaagaagaatgtttatgaaatcttttcttggagttccgcaaatcatggaactactgggaggcatcctggaggatcttgagtatttgacctgaaataaaaatggcttagcagtactcccttcacttcttactaaggaagtcccttggtcagatctactgagcacccactgcctcagtcagtgtttcacaagtgagattcctagaccatagcattagcaacacctgggaggttgttggaagtgcagtttctcaggtcccaccctagacctcctgtgtcaggaacttcggggctggagcttaaaactctgtgttttaacaagcccttccaaggagtctgaggcacagtgcatgctcaagtttgaaaatcactggtctcagtgatcgctggtgaacttttctgttgctattctatgtcctgccaagtgagggagcactttgtaggtctttgccacactgtacccctctttcccacagacccaagcaacttttaaaaagagggatgactagttagtcatcaaatacaagaataactctttttgttatttttttattataaaagatacataacctaaaatttgccgtttaaaaccttttaaagtgtacaattcagtcattaattatactcacaatattgtagaactatttccactatctactgtcaaaactttgttgttaccccctaaattctgtctgtaatcattaagcaataacttcccactccccttcccctcaacccctggtaaccactgatctactttctgtctctatttctcatcattttatgggtatctcatgtaagtggaatgaattgcacaatatttgtctttgtatgaatgacaacgttttgaaatgctagttgcattcatgctggaaggtgctaagccttggtaccgcatatggccatgttacatctcaatcaaacaggacagataacagtcaggtttgtcttcaatgtgctctttaactggagcaaaatcagatacatttttgttcatctattgaatcagaaactgtctgctgggtgcctgctctgtgctgtgcattgagataggatatcacatcttttcttttgtgctgccagatatttcaagagtggattatatcataggtacatttgacttataagagttcaactaagtgtgtggtatagtgaatattctattgtagtcaaatagcaaacattctgtagaattctattttgcatatatatgcttaattatattatttactcattatacctctctatatacatattgcagtataggattatagttgtacatccatgtataatggacttttgaattgtttaaggaagttaaattattttaagggtaatgtttgccttaagtgctaacttgagagtcacacctctatgtagaaagagactctcttgtttgtgagaacttattgcaatcccggtctgctcctttcccctcagacattagctttttccttcccagtgctggggattcccaaaagcttttgtctgagcccttgttctgatgctgttgcttgtgaatttggaagtacttcaaaaccatttctcctttgcagagtctctgcttatgacaagccaggcagaatggggccctcccagcctcgattgtggtgctctgctcctggttctatctcaggcagtagccatcctctgtcacactccctgctgagtgttcgtaaccaaaccagtctgagatctgggtttcattttctcttaaaaaaatttcccgtgattgatgaggattcctgcatctgtctttgacagcatctggatagagttgtaggggaggaggttctttgtttccaaagaaaaatggacgagctccatcctgggcacaggatctggttccatttctgcaccatatgtttattatgctttttctttcctttcagcatgcagaagccatctcagtttctgtttctgttttctcctctctcccttgaaaatggtggttagcaagatccgtgtgttaccacttttcttggtcacctggctctgtgtgtgtgtgtgagtgtatatgtatgcgtgtgtgtgtgtgtgtgtgtgtgtgtgtgtgtgtgtgtgtgattttatgcatcctgctagtccctctcaattcaggcaggaggccggcgctgtagcagatggtattctaaacaacatgttcaatcccttttaaaggtcctcctgctttatccacctgttatttggctaactcctttggttcttcactttctttttccgctgcaacaaccccttgtcccactgccaactctagtgaggctctaggattaaattctagggccaccttcttccttctttctgaaatctctccaaaaaagctcgctagtgccagtgctcaatgtggtgttggacagcaggtgttaagtacctgacattgcagtgagacagatgcccagtgaagttccagatctgctgctttctaacatggctacttcaggcaggttaagttacctttcttagtctcttcatctgtaaaatggcgattgttatgagaagtaactgagctagtattttctcagcaatctcacagcaatctgtcaagaaatcccatcagttctaaatctaaaacatatccacgtgcttcttgagatcactccaattgtaccatgaagaacagtttgaacgggtcctagagtggatatggatgtgtcattttggggactactgcaatagttaggtgaaaaatgatacttgtgtgatttctatttatttcaatctttagcaatattttttcaagtgttctctagttctcagtataaaaggatgccttttgttaaattgattaccaggaattgtactctttttgctgctaagattagtgggatttaaacaaaatcatttctgaattttcattgctaatgtatagagatacaattgacgtttgtatgttaatctgttatcatggccaccttgcaaaacttgtttattagttttaatagtttttagtgactaagatttttctgtacccaagatcacgccatctgcaaatagacatagttttatttcttattttccaaactacatgccatttatttatttatttatttatttattcatttatgcttaagtgccctgactacaatctccagtataatgttaagcagaggtagcagaatatgtatctttatcttatttctgatcttaggggaaaagcattcaatctttcttcattaagtatcatattaactgtggattttctataggccactttatcagtttgaggaagtttcctttgattccatcttattgaataattttgtaagaaaaatatgatggattttatcaaatacttttcctgcgtgttttgagatgatcaggtattttcaaattctttattctgttattatggtgggttactacattgactgaatttcagatgtcaaaccaaccctgcattcctggactaaatcccatttactcctgtgtgtaatcctttttacttgttgctgtgtttagtttgctccacatggctttctactggtctctggcttctactcttgtcttcctagtcctttaaaaaaaatgtagagttgtcagagaagtcttcttaaaacatgctaaatcattgctcaaaatccagtagagaatcctccacttacggtgaagccaaagcccttatagtacctacctcatctcagtcctgctccactcctgtcatcctcaactctagcagccctgcccatctcactgttccttgaacaggtcagggctattgtcaccttacagtgtctgtactggctgtcccctcagctcagcagatgcttctcctgataattgcatgacaaccacttcctctccatatttttatttatatgttgctttatcaaagaagtctactccagccaaccttttaaatcttgtaacccattcctctacagctgatctctttaccttgttgttgttttttctttttttccccatggcatttatcacatctaagaatactaatttagtgggcttttcaaaaatacttttgtctattggctatttctttcactttaattccctcaaacataagctctttgggtgtaagagtctttggtttatcagtttgtcttgacacatagcaggtcctcagtaaatatttgttgaacgaaagaataatataactaaggctcttagaccagtgcctagcttttgaaaaaggtttagcaaacatttgatggttatctgtgttcaaataagactaagtggtaggggtagaatagtagaaaacaaaacatgtttcctattttctggagcttgcagagtggaagaggagacagaaattaataaaacaatcacacaactgagtgaataactgcaaactaaattgtgcaatgagaaaagaggaaaaaaggatgaatgtacctaacagaggactaggggtcaagggagtctttctacaggaaatgacacctaagttaggatgtaaaggataaagtatgagatacaggtaaagaaggggagaaaggcccagggcattttaggctgcagcattagcaaggtcaaaggacaagccatgggtacatgctctaggtcttggaaaaagaacagtggggcagaggtatagaaagcaagagaaagtggtgtgggacaaagctggagagggtggcatctgccagattcagtagggcctcctggtccatgtttcagatttggattttttatccagagcaagagtggatgtggggtagcaatgtgagggtgctcaaatctgagcctctgattgagaagaccactctagttgcagactggagaacagcttgaaggagatacagagtggatatggatagattagttttggggctatagcagtagttgggtgagagatatttgggtgattttaatttatttcatttctttttgcttaattatattttctaatatacctaaggaataacctaggaagttaaaatatatgttccaaccaaggaccaatagctctagaaattacatttctcattaaagtaccagaccctcacatgcttaggctagggtgacaacagcagagatcaaaaggaatggacaacttaagagctctctagaagttacaaagtggtgtttgaggaaatgatggagatctaggtggaaagggcaggtggtgttaagggtgcatgttcaacttctgggaagatagtatttccactctctgaaaaggggacgtctggggagggtcaagtcttggtgaagtgaatgttaggttgctggtatctggatgctaaacattgcaagaagctttgggtgggggacagactctcaggtggccccctgccatgatcctcacctcctgttgtttatacctttatgttatttcctgcctttgaggatgggaaagagctgaaacttgtttttaacccacagaatatggcaaggtaaggacatgtcatccctggtcacccctgtgattatattacataattgtgttataagaggtcattgcatatgtactctctatagaaactttcctcattgatgaagtaagcagtaatgttggggaaacccccattgcaaagaacagttggtggcttgtagaaactgcaggtagcctctagaaatgcagagtggtcttactgtctgttgatacagcaagccggcagtgtccttggccttggcactgcaaggaaaggtattttaccaagaacctgtttgagttgggaaacatccttccccagttgagcctcaagatgaagactcagccctggctgatgccttgattgcagccttgtcagaccgtaagcagaggatccacctaagtggattcctgccccatataaactgtgagataatacatgaatattgcttcaagctgctacaattgtggtaacattacactgcaattgataactaatatgggtggcattgctatatctaggccatctgtgccacagaatatctgacttccaagagatagtttggtcctatgtttcctccatgtacccagggataggagcacattttttctccagtgacctctcctgactggtgaatgatgaccctgcaggctcactgcctgcaaacacatatacagagataaacccacttcctcacttggtacccattccaccttccatgatccaagaatgacattcaagttattaggttggtccaaatgtaattgtggtttttgccattacttttaatggcaaaaattacgtttggaccaacctaataatattacatttcaggggctctagtaagctttttaacgtaatttaatttaaattttactttatctcactcttcacaccatcccatcagttagatcttatacccactttataaatgagaaaggctatgagattcagagagatcaagtaaacccagaacccagaagcagaaaagtggctgctccaagcttcaaacccaagccctctaattcctaatttagcaactcagtcctgccactcaaagatgcctgtgacttgcttctccttgagttctttgtctttgtctccatgaccaccattgaacatctaaacccgcttaagctgtaccacactgtgctatgtagaatcttgaatcaaacagtggactcaagctggacaagttgtttgcctcattggctctgtgatgtatgaatcctctgaccttgcaccagtcatctaaccttttgatctccacaatccttatttgaaagataaaaatattgcacagagagatattttagattctttctagaattatgttaaaagtagagagaagactttaggatcactagatttaaattcacccagaggtagacttatagctaatgctgcctctttttttttttttttttttttttttagatggagtttcactctgttgcccgggctggagtgcagtggcacaatcttggttcactgcaacctctactgcctgggttcaagcaattctcctgcctcagcctcacaagtaactgggattacaggggcctgccaccatgcccagctaattttttgtagtttttagtagagatggggtttcactatcttggccaggctggcgttgaactcttcaccttgtgatccacctgcctcggcctcccaaagtgctgggattacaggcatgagccatcaagtccagtgaatactgcctcttgctagctgctgaaacttgggaagattatttaacctttgtgaacttcattattgctgtttgtaaaccaagactaataatttcaccctctagcattcccgtgaagatcaaatgtgatgtataatgatgtatataggacatttagcttgctgcttggcatttataggtgctccctaaataggggtgataaatattcaagactcctctgtaatggctcttaaaatttacttcaacttgaagacgtaaattgaactgttgcaattctgttgtgttttgctaaaatcttaacgagaggatatttacaaatttgccaatagtttaagcttagctttttctgaaaaggagagtggacgtgaactgtgacctctagaatcttaactgagttatcctacagtatgaaaatagataggatgtgggcggttccactttgcctttggctgttataactctcttggagcaagatgttctgcaaaaatttctgaaatgattctttcattgatgtaaacatggggacatccatttggaggacattctggcacttctactttctatctcccctgggcatcccatagggaagctcaaacaatgggggatgatgttatgagtttacactctaagaaaacagtgccctcccaagaagtcctcttcaggccgtgcacagtgactcatggctcatgcctgtaatcctagcactttgggaggctgagacaggcagctcacttgaggtcaggagtttgagaccagcctagccaacatggtgaaaccccgtctctactaaaaatacaaaaattagccaggcatggtggcatgcctgtaatcccagctacctgggaggctgaatcaggagactcactcgaacccaagaggtggaggttgcagtgagctgagattgtacaactacactccagcctgggggacaagtgcaaaactccatcaaaaaaaaataaaaaataaaaaatgaaaagaagtcctattctataaaatcagtgcagctaccagaaccatgggtgtcagatgtgcacatccagcagaaggcagtcttgcactccaaaggcactgactgtgggcccccagttcacgcactcaatacaatgggcttggctcttggagtggaagtaactgaatgccttcttagttgtttaagttttagcagcttaagcttttgctttttgtgggcttagcagttggttgacagagtagttgcctcggctctgataggttttacttctttcttcatgcttcgctgtgggagcagacaagtggcagagcagcaatgatgagagtggaccagcgctgcagacatgtaaccactgaataaaccaaaaatcaagagcctcttggtgacatgcacatgagcgactcgatgtctggatccttggcactgcgtatgggagatgaagtgctttcagtttgctcattagttgatttcagatgtttattcttatacagatcttatgtggacactacatccaaaacaacatatttacaaacttttttttttttaaggaaagcacttatatcacattcccagtaggtacacaagtgtatgttcatgcattgaagtgaaaatttcttagatcactgctaacctttgctacatgaaatgactctgatatattaaatttcattttgatttctatttcattaaaaactatagttgatacctataaaattgacttcacaatgcactattgggtcaaaatttccagtttgaaaaacagtgtgcctagacagtctggtgaagttcagtttccaaactaatcatccgcaggtctcctagttcctcaaatgcacatcttctgactcctttaggggtttcctatcctctagtgttgatgtcttcctggggcagccctctattctgctcttgattgaatttcctctccgatatcacctgcttgcctggctatgatgatcattgctgctgtagtgattcataaatgtatattcctaactgtggttgcgttcctgaattctgtatgatgtttccagcagcattccaaacagtttcatgtagccttctgttgtacccttcatcttgaactcagcaccaaaatcaaaatcattattttgtctaaacactgcaacttctcttcttagtctattaatggctctcttattcccctatctacctagcctaactattccaggccatcactgactcttcactctccttcaccctccgcagctcacctttcctcagctctcgttaattttttgctcacaacttctctctcacttttccattttgacaccacatcatctcaatttaaaaaaccaaatggcttctcattacctacagagttgaatgttaactctttagaatattggactttggcctcaaatcttatctccatcattgccctaaatgtgccctttgctgcactaaacattgatctcctacttatgccctaggaagaaataaatattttctagtttctcaggaataagcctcaatttttttgatgaatgtgacacttatcatgcatttccagctatataatgtcactgtttggattaatatttatttaggttagcatattattaggtactttctagagagttgtgatctgggagtcaccttgaattgctctctcaacatcgaaagggtaactaagccatactgatactgtcccctaaaccaattatcctaaaactttcatgtgcatataaattatctgttagaataaagattcttattcagcaggccagggatgtggtttgagattctgcgtttctatctggctttcagaaaatgtgaggctgctggttagagacccacactttgagtagcaagattcaaatgtggctttaacccatcccttcttcctccatgccactttttgggtttaagaccttattattacttattctcctgactggtctatttgccacctgtccctccccaccactagtctgtctcataaaaccattatctaatggatcattacttcatttgtgaacttcctaaaacaaaagtgcaatggaaattagaaatgcgatccttagagacctggcctctgaactaggattgggttaggcgccttgcttgggacatccttattctattcctgtttctgtggtttccttcttctctgctcattcattttgatgaaattaattaggctgttctgcttttcccaaaacactgattttctttttgccccagcccaagccaggccccatatactatggcacctggatttttcacacaacttgaattttcagaaacaccttccatgtgttccgttttcaatccactgttgtgaaaactctgtgggattcaacaacagtgggattgaagaagctgaaagttgataagaggaaaaccgtttgaaggataaatgaagtagtccatccatgaaagctagcctcgccctcttttaactgccctatggtcattttggtctccctgagtgggggtgtcatcccagttgtgggtttgcacaggggcctgtgaatttcaggcttttgctcttgtggaactgccttgtaggttatggggagcaatgctttcacatgtactgcttttctactgtattttactttatatttattctttcatttatcttcctttttactgctggctctgttgttcagtattagctaatatattgcaaagtgagctttcattgaccaggcagaggccagggtagggccactgagagattctggagaacaacagatggggaggaagcagaggtgtgcagcgagattcctgggattgggatcccagctctgctgacatgtctgtacagtcttggaagtgtgatctagcctctttggcctgttcctccaatcctgagagaggtggtggaaacagatcactgcttagcaggccttagggataagttactagggccacacagaatcttctatttttttaaaaaagcaaacacaactctcctccctataattatactacactgccctcaatgccagtgaagttttcctttgccctgtaggtagatttttgtgtgaccttctcagaagcaggaaacagattgaaaagccactaagatgtgggtcaaaaagtatttttcattctcatatgtgtccctttgttgcaaagactgtgacattcctccatggcagaaaggaatgaatttggaagaaaaatcccaacataactattttccaccctaaggaaacagcctctctttgcaatgtgtgaatgcattttccactgcatccccaggggtatgagtgtttcaagaagtttgcactgtgctgctacattcactaagcccccaagccccactccttcccagaccatcctccagagtccctgcaagtttccagaaacaaacaaatcaagagactgacaagagctctgcctggtatgaataatagaaaaatgagccactctgtgcaaggaagttggtggaaggtgggaggcaagcaggggagagaaagagattttcagcagcagaggggacctcagagacccatctacaagacggacacttcgctcagcgttatttctgcatttatgcctctttaatggtcagcggggcaatcaatagattgcctgctacctggttaatcatgggtctgttatggggtggcaatgggcatgctggctgtgggatccatgtgctgagaaaaagaccattgaatgttgactgttacttttctttctctttccccagggcagccactgaagttttggcagcattgctgaaatccagtaagcacctcttttgaagggtggctatttctctccactctgggtttaatgaaagatactttctggtccccatggctgtttctttttttttttttttcatgaactactatttctcaatcacctatggctaattcctgaccttgaaagtgataaagtcatgtcgtgggtctttgggggtaagatagagaatattatggctgttccaggtacatgaccacaaagagaaaataaatattatccatacacaatgccaccaagacaatggaccctaaagggggtatattgactactgtggagctgatggaccctccacccctgtctaacagagccagcagtccctaaagattgttgaaataaattccaggttccagtgggattgcctccaggtcccagtggaagaaaagattttggctggctggagagaagtattcctgtatttggttctcaactcagctcagctcatgagtctatattcttgggcaggtggagtgctgggaattgcttggacaatgatgatgctgataacaaatttatatttaaaagttgactcttttctcagttacttgagtgattgcaaaagaatagctctggggttctgaataatttgaggaattttttgcctggtagccctggcctaattacgttgggagtcaatttcatgtgtgcaatataatagcaggcacaatgcacttgggagggaagaagtcttagcttaatgtttttactcattttttcctccttacctcttcatctattttaatttggcaccttggaagccagctgcttcaattgtgatatttgtttctctatagggagcctgaggcctgtgggtaataggtgaactttaataaaacttttaaataaataaataaaaataaaaacactctctccccccatccatacatctctgtcaactataagcagagagaaagagccaaatcacatgctgtttccctttataggcttagaaaaattgaagcttgaattcatttggtttatttgaatttgatatgagatgcaagtccacatctgtggacttgacatgagataagcttgataagctgtgatatgagataacttgagataacttgataagctgtgatatgagatccacagcttaaagacctgcaggtagagtggaggtggtaagagcaggataggggagtgaagaggaagggcttatgaagccctggagataggaagggatggaaaagtgttactgtgggttctggggagaggaccattcattcttcagactgaacttgcttcaggtttggcatctcggttctcattatttatctgctccctcggttgctcccaaatgcctggtgtttgaagcaccaaggtgagggggtgttgaattgcaggaggaaaagatgctgagagcagcctggtaggccagcctgtgaatgtcatgccttgggaaagaagctatctctcaaatccccccagcccagccttggcatggaggacttgatgtttcatgggaagggagcccagagagctgagtaaggctggcttactttctacatacacactttccttagctcttgagcttacggttgagcatcctgatataaattgtacctacctagatgtgtaaaactctgaaagtagtcttatgtcagttgtttactctattgatcaggaacacaatgcctcagcccaggaaaaaccaatagccagtgcaaacacggcttgattcaggctcagaccgtgtagctaggttttcaacacaccagccatgcctagtaggctgagtgtgcagtgatgggcctcagcttttagaatttctaacttcttctttccctttagagcttagctcagatattgcctcctctgaaaatcctttctctgactaccacaacttggatgcccctcaccaatgcttttataggctctcccaactcagacttgattacattgtgatgaaattgctattgtctgtctcttccagcagactgcaagcttttgagggagagagtcatctgtattggttgttgtattacttgcctcagcacaatgaaaatcctgaaataagtatttgttgactaaattttttttgttgttgttttctttttaaaataattttgagtactgggataccaaatttttaaatgaatacatgatttgtgatttttcccatgtgtaaaaatggcagtactgcccccttctaccagaatctaacatccatgcatagaaccaatgatctaaacatttgtgattctcatctctatttacctgttctaacagattggtggagaactgcaatagcttgctgtcctccacatataaaacgggttttagtgtcccactaggaggatgtatagcctatttgctaattctgctgagctgtctatacatctttggtgttaattataacacaaggtagttggatgagaggttctctaacattctttctaacactaaatactcagccttaatgtgtatcagggtttctcaatgtaccattggcattttggacaggataattctttgctgttagagtctgttctgtgcattgcaggatatacagcaacatccctggcctctacccaccagacgccagtatcatgcctcagttgtaaccaaaaaattatcttcagactctgccaaatatcccccatggggggtggacagtaaaatttccacttgttgagaatcactgatgtgtatgtatttgggtacacacatgagctgaagctcattcaaagtttcaaaagaccccttccaaaatacctttattgatatttccaagaaatgcacttcttgcataattgatgtgaaattcctcagtatcagcctcattcatatgggttcataagaggtaagaacactgaaggcagaatgtcattgtgagcatttacaaagtactttggagggaaacagattctacaggatcttgagggtctgagaatgaggagggcaaatagatttaataatgagtagaaagtccaatgtgtgggtaggagaattctgagatcatgtttaagctcagcaagaaagaggacttcatttaaatcgcaaagtctgtcatggatttggggagaagtaataacagcatgctaggcagctgccgtctttgttttaccagcctatcaaaagtattgatggcatgaagggtctggttatagatggtaccaacattctgatgagtcaggggttgctgcagggcatagaagtgttgtggaattttctatttgctttacattgcctatatgtcatgtatagttaagacctgatgtggaatatctttcgacttggaccccagagtgagtttgcctcagccgaacttaaattcaggaagtcagtttctgtctaaaattcaagacttcaccatctggcactgatatctgggaacgtttatgtaaacctttagctcctaaaggcacactccttttagctggtgattattctgagcttgatctttgcttgtcagtgagtgtaaaagttggccattgtaatcgttctctgtaattgcatcccaaaaaggaaataattctctgatctaagtaaagccaggagtaaagacccactactctgcagggagagggggcagtcagtggtcctgtgacagtaaacactagggtgggttggaaatctgaggccactgaggccctatcaagtagtgacaggcggaggtcatccccaggaaaagcagaagtgagggatcagggagacttggagtctacccacagtaaccacagaaagcaagggaaagatcacctgcattgcatttggaagatctcattattcagctttctcttttatcaagtagtgactgcatgaaaagccagtgtagaatatgtgggtgttgggaaaagaaaaatgaacaaacacatttcccgtctctgtctctttctgggcaatagcaggcaaaataaacctggaaatcctagttctcttctccagttatctcagcaatttgggatcctacaaattaaaaatcattgctcactcaaggttcctttctgtgtctatgtaggctggaatggtctaatccaaatcccgtgcctttccttgtatcagttcccctcttctccactctcacatgcacaaatcccaccctaaattgtcctgtattgaaagttttgcctttttatgctttatcctatccaaacacatttagctttttattcctgaaatgtagtaaagctttagtcaggaaatagtgctacttattattgcaggaaattttttaatataataaatcaaaacaacatgtcctttgtttttccctctgtattagtctgttctcatgctgctatgaagaaatacctgaggctgggtaatttacaaaggaaagaggtttaattgactcagttttgcagggctgaggaggcctcaggaaacttacaatcatggcagaaggggaagcaaacatgtccttcttcacatggcaatagcaaggagaagtgccaagcaaaagggcaaaaaaacccttatgaaaccatcacatctcatgagaactcactcactatcaggagaacagcatgagggtaactgcccccgtgattcaattacctcccaccaggtccctttgattcaagatgagatttgggcggggacacagccaaaccatatcaccctttcttatcatctgccttcactctgcctttatctcatctcatcttcttctaccttcatctctgtcttttcctctttttccctcatcctttttgtcatttctcatttccctgtccacctttccctctttctttttgcttcctcaattaccttccatgagcattaggcataaatgcatttttgaaaaattgtgaccctggaagcggcacttgagtaagtgtgcggcaatgggattatgcctgatttgtactggctccagaaatgaatcttcaaataatgtcttagtattaaccttgctgtccagatttaaaggtcatattcttgcaacaagaaaacgccttctggttcaggccctaaaacttaataagggaatgataagtctctgtcagaccactctccaatttaagaattagcatttaaaggagtctggaagtttgcagaagttggggcatgggaacagaaaagcaagttagcaaaggaagagcgacagagaagaaaagggggagggagagatgtaaaagagctaatgggaagtttggcaggaagttgagacttctcacagatcttcctcgttaatgctctgtctggctggttcacagggacagcccgtcagcctgttgctccaggaggctaggaagggagggcattctaagtgctgagagccggatcaggaacagacagcctcatagtctcaggagtcgtctgctgtgacctggcaatcagcaatgcagagacgggagaatgtgattgatggccaaatggctgctctactacaaaatgtcaaagaaggggccatctttgatatgcacccaaatcaggtctttataagaattctaagagttccaaggagtcctcagaatggcaatatatgtttaggatggttggcattgttaatcctttgatctcatgaccatgcacaagtaccagtggatcaatgcagctgtcactgaacttgcatgtaaattctgtgtttccacactgcctgtggtctgccctcctggctccgggctctgccctgccttgatgagaatgatgcccccaaagttttgcccacagagtgtatttcttcctttagtttccagatgagggccatggagtcagactacgagaactggaaaacaccttcaaggctgtctcatccagggatattcaaatatttgtttttaaaaattcgttcttattattcatttttaattgaaaagttaaaatgtatatatttgtggtgcaccacatgatgctttgaaatatgtagacattgtgatggttgaattgaggtaattgacacatgcagtttttgagtagagagctcagagtcacgtctgcccggctcccatcaattagccccaaggcggcctctgagacacagtcacaaaaaacagggctcctgtgaacacagaaaactattgatcttacctcccccatcccccttattttcacaggaggaaactgaggaccagagagagggcgtgatccacctagatctctgagacttcgaatgtttcatgtccagcccttctttgggtcttggcacaaataacactgttcatagaaccttatgtttatatttcagagaactaaccatactgtaattgatgaatcatgttttttttgcatattatgtgtgtatgcatatttttcctactgggtatagctccaaaggaactgggattctactggatcccccatacctcatactgggctacacccagagtagctgataatacattaatgttgactaagaaagaattccaggttcctgactttagcctcacacatttgctttcagtatgccttggtgaagagtccagcctaattcccgtccccagaaggaatcaaattgtggcatgattatagagctgatgtctcttcttccaccataacttctggagaagcatgcagtatatttctgtgatgagccaaaaatttgcttcaaataatattgatagatttttgcatttgttacactgggatggacggctgtgattgagtgtgcaggaatgcagcatagcaagctatatccatcacgctgttggtttgaaatgacaacccaaatatctaccatttagcaagagttcttagtatgtcaggcactctatacacagttagcctatcaaggagattttataatccccattttacagatgtaggaactgaagtttggaaagctgaagtaactcacatcgttagtgggctgcagggcttacctgccagtctccagacccctgggacctgagctctgtgctgaaccgaggaaattaatgaggctaggtttatttagcctaaagaagatatgactggaagctgaaaaaaagctaaataaatactgtctaagtattagaaggattattgtgggagggggtatctgtcattgaggttagaaaagaacatggtccatgccttgtaggcatctgagtgggacccagcaagaggtacccagcacaccaccatggctgtgtaaagggccagggtctctgctgccctgaggccgagcctcaggccggccgatgaatggtggggtgagagagaggaaggaagcaggaagaattacagactcctcatgccatgctgtgttcaacttggcacatggctttttttcctgggctccaaattcagtcctctctgccaaaatgttatgtcttttgcataagtccatagaagagcttaaaaggtttaagctaaagggatactacctgtcctcgtcgcccccatccctgtccccttgggacggtcagacccagtaggttgggcgggccttgggctgagccgcagacagtaaagcatatcgttcctcttccggccatgtggtggtgctgttcttttagttatcttggccgcgctagtccaatatttattttcagtgagtaatttgtttatcaggaggttattttaatgtaattttggccatatttgctattccatactatctgtgcttcccagcgttagcagcttgcgtgtcttgaaggaaattagctgaagatggtctcagaggcatttgctaagccattatttaagggagttgggaggaggcagggtgagcagagccaggggtgggaacagccgatggaatttgttgcattttcagtgatgttagcatgatggatcgggacttacggagggcaggagcacccggagctgctttttcagagctgcctctggtgaatcctagaacatcttgtagttacgtctccccatttcccctctcgctctttgataacctgttatcttccttgcctggtcaggaaaacaccatgtaaggacaatgccctcctgcctccccgccctgcatgtagccctcatgccgtgtcatagtatattttgtgaaccttttactgccagccctcagcgaagtgggaaggagggtagggagtagggagagaatgagtgtttattagagtacctgcactgaataatgactatcaataattacggagcacagcacttgctaggcactttacacatggcatctcattctcactagagcctgtaatattatgatccccattttacatgcaaggaaggtgtaatcaggagaggttagtgacttgcccaagatcccacacatggtaaacgaagagctaaaatttgaactcagttgtgaccatttccaaaggagaaaagcttcatatttcaaagattattcccaccttccacatggagtcaggaaactggactctgggttcaatgcagccattgattggctctgtgactttaaactagttctttgctagtttaaatcttaccaattatcaaactgaaatcaaacacttgacttcagtttggtttttcaaacatgggagggctagcccaggcgaggagattagaaattctttagtagcaaaaccttttttttttttttcttgaacataaaatcttttgagggaaattgcatgcataaagcaaacaatggggagtaaggggagaccccaattaatgacagcatgacttgtcctttgcccctccctttccttgcctcttgataggcattgagaaacacccaaagaagttcctgaggggccagaagaaatcaagtttgaaaacctctgaagtaaatatactcaagggactctttcagagcccagtctgttgtttgagattacaacttaaaaaatgggctgacactttccttgggaggtttgaaaatgtgttaaatcttactatgcagtggcaagaaggaagaactagtgaagtttgacctggaggaagatccaaaatattgttctcatcctccagccctagtcaagtaaattctgagtctcttgggactaacagacctaatgaaacaattgaactgaacctgacccagtgaggagggtcagcttccagttgggattttactggcaggcaggatgggcagtataattccaccttcccaaggtggccagggtgttcccaggcacccattctgggtccaacacagctgtggatggtggtgttgagtttttcttgtttgagacaaaactcttggtcacataagatattgttgggttgtgattgccactaatcctagttcttacactcatgcaggatgctgtcttttatcaggagatcctgtcaagacttagttctatctcaagggctattcctctgtcctgtgtatctgcttgtaggtttcagccatgttgtttctttgaccatagtataaaagtgctcaaggtggcttggtggcatgtgtgcagaatggtgtatgttccctgtaagctcagaactcttactccgaaagagtaagtcacaaggccgagagcggtggctcatgcctctaatcccagcactttgggaggccaaggtgggcagatcacaaggtcaagagttccagaccagcctgaccaatatggtgaaatcccgtctctactaaaaatacaaaaattagctgtgcgtgatggcatgcacttgtagtcccagctatttgggaggctgaggcagaagaattgcttgaactctggaggcggaggttgcagtgagcgaagatcacaccactgcactccagcctgggcgacagagtgagactctatctcaaaaaaaaaaaaaaaaaaaaaaagagtaagtcacagtggagaatagcacttgctcagtggtcactgtgcaggctctggaaagactgtgtagagttgaactgtggccactgtggcatgtttcttaatgactctgtgctacacttccctcatctgtaaagcagggaaaacagtacactccaaagataattggtaagatttaaacaaggtgatgtttaaaagagtgggagtacagtactggatcttggtacatctcaataaagatgaactcttgttttattgtcatcaccatttcaaaagtcctggaggtttcaggaagtgatgatataagggcataaagcctgatgaaatgtaaatttgtctcccaagatcttccccgagggttgaatgatatctggttgtttttagagtctgtctttttttcaagaagctttttctgtaaaagcgccagatgatagtaaatattttacggtttgtggatcagacagttctgtcacagctacttaactcttcccttataggacaaaaacagcaacagacaacatataaagaagtgaaaaacttcatgaaaacgggctgtgggcaatttgctgaccccctactttagactatgtgagcctcggatctggggactctgttttattcttatttcttaagctattcttcttattcttatttcttattcattcttccttatttcttaagctattgactctaatgtgttttatagagtggacactcagagtaagttatctaaatgaacaaaggaatcagtgaataagtgaatgcgtgcagattgaaccctgctcaatcaatccgcatgcacttgttttgttttactctagggaatcaaaggttaatatccaaggttgatgagttctaaatgtcttaaattttagaacttgtatcatcccggcataattgatgactggctatggattgacaaagataaattatcacaaagatttaaggagatagagaaaaatataaacatttcatgactcagaaagtacatcatggcttcctcatcactttcaggattggctgtacaattatttatttacatcaagatgtacctaaggtgtttcctagcaccttctaataacagcagtttacaaagcagcttttcatatatacaatctcatttaatcttcaccatggtcctgtcagacgggtaaatatttaattattctataacagtagttctcaacatgagtgactttgccccagagggagcaattagcaaggtctggagacatttgtggttgtcacatctgtggtgggagagggtgtgctgctggcatcaactgagtaaaggccagattgctgctgaacatcctacaaatgcacaggatggccccacacaatgagtaatatcagcccaagatgtcagtagtgtgaggatgagaaaaatagtgttctatacagaggacactgaggccgaaagagattgactgacttgcccgagattgtgtaatatgcacttggcatattgggactaacctctactccttcctttcactactgcaggttttaaacttttttttgaaagaaatgaatgtttatttttattttcaaatgaaatcctttgcagagccactgtatataaacagatgacagtgtagctgctctggggacaatggaagttagagacgctgctcagcctttttcttagccccttccaccagtcccaggggcacacagtatggcaaccactgcccacagaccgtgaggcacacagagcactagacatctcttggcaccccagacttccagatgtccctggaaactactactttttttttttttttttttccagtaggggatgaagcatccaaattctgcttcaataaaatgcattgcacagaagaagagagaatggaagcattggggtcacatatgaggctattgattgctggtgcagcccaggtaataggagaggatggacatatcgagagtgataggagttgagttaaaaggagaatgcacacggctcaaggttctgtgattgcatagtgttacagctctgaggactggaggaacaccaggatccttagtctcgggccgaattggataaaacgacatgaacacacatggagtagttttaaggagtggagagtttaatagtaaagaaagaaggaagaagcctccccatacagagacagagggaggggggctccaaagccgagagaggaaaccagagtgcggcagaaatcagctggaggctggaggagggggtatctgatttgcatagggctcaggggattggtttgaccaggcgtgtcattcacatagcccggggaaaaaactgaccctcccaccctagccttttaatatgcaaatacagggtaccctgatgttccacacacacggggatatgtgggcgggggggggcgggggggggcgggggggcgccaagttgccaggcacatgttggggcaagggcaagaagatgtgggtgggcccagtttctaatggtggactcagtttttaatggcccacatttgcatatcaaagctggccagcccagctctaaaagccgggcctttcctgctagacaagaaacgttctggagctactttaaaagaaacaaaaacttcccaaggaccctctttcctctgtatctgcctaaaataatttcttaataactcctataacaatagtgacacactattggctgacataaggctgaagggtggcaggctcaggggtgcagaagcatttgctatttgcctcttcctcatacactcagggcctagaggcacaatgcagtgtgaaccgattcatgagcgatgcttgcaacgcagggcagaattgctttcctgctgtctatgttggttgtctgtactctggccagaagcaggcagcatcactggtggacagacgggtgccttaaatatcaagttggggagaaaggaaggtgagggaaggtctctgattttcttcttcttgatgtaaatcctggctttcttctttaagtgtcatcctctgatgagttgacagtggacacagcaaagtcaaaccaggtggaagattttctagacctggaagggataatggcttgtcttggggtttagcaagtacttccttccccacccacagtctagactcaaaataaaaatttggatggataaaaaaactcctatacaaatttctaggcctatttctaagacaattattctgaagggtcttcttgcagagatgcaaaaacaacagaaaggcgagtgagaaattctcagcctgacagattcccccgcttttgcacaacctgttgggatgagtctcaaaatggtggggggtcacacatcctgatccctgctcacctttcccgtcatctgctactactgtccccttgctttcttcacctggctttagctcctggacttttcattatttgtacttaccaagtttttgctttatccacttgctgtgtgcccttgaggtttgaagaatttcctatccccagatctctgcatcctggttccttcttgtcgctcatgcctcagctccaatgccccctcctcaagggtcttccctgatcatccaacctaaagcagccaccctacctcatcactctagtgccactgttttgttttctctgtatcacttgtctctatgtgaaattgccttgtttagttttctttgtgtgtgcctatttggtatctgcctccccctgccactcctgtgggactgcaaaccccataagaggtgaggctttctctatttcattttctgctgcatctctgttgtcaataatagtgcctggaacaactggtatatcgtagttgctaaataaatgtttgctgaatggattaagggtggtaccttgggttttgggtgtgtgaacatggttttagtttataatttactctctgcctagccatagggagaatctggctttccggacaaaggcctgtatgtttatttgcatctaagaagcaaacctcccaagagtctaccatgttagagaattttcaaactagcaatattgaaaaatcaaccatattttctcaaatctaagtctatcatcaactgtgaggtgtatgccattttttatgtgccactgagtgagaaaatgctgtcagttacaatgaaaacatcacccttggtaagaagcaccttaatttcagaaatgctaaaatgtggataaacatatgcctgaggattgataaagtatgtgagatagactcctcatatggaatgtagaatgttgactcagaagagtttcgagtcttgtggcgccttctatgtttatttttcaaatttattttttatttttatttttttgtagagatgggggtctcactctgttgtccaggctggtcttgaactcctggctcaagcaatgcttctgccttggcctcccaaagtgctggaattacaggcatgcccctttctcttcataggtgcagcattgcaacctaaggtccttcattagacattgtatgtgctgagggtgggggaagagcagagatgtgtgaggaagagaaaggtgtggattctgaggctttactgaaagtagagaaattcctgtggtttgggactagttctgtggcaagttattagaaggagttgaggatttataaaaagatagattcatctagatttaaaacagtggtctgaagtgtagtctcttacctgtcccggtttctggagcttcggaaaagcatctttaattttataaaggcagtcaattgagaaaacaagatttgcttgaaaccaaaatttactttatagccaagtttattgaaatgtatctattttacaaagagaaaaaaagtacccgaaagctaattcaaaaccatcattcttatttgagaaatgataatcaagtataatttccattatggatggcattaggtttccttatgcttttgtacatatccttatgcttttggctgttctcctttgcaccagccactcctgcagctgcagggcaggaggaggtggcagttgattccacctctcttcaatggtgccgcactcacacctgggcctgacattgctgggccggcctcactgtgtcattggctggatgtaaagaagtccccaaaacatcttctccagggactcaaagaaccataggctatttatttgggtctttaaaccttttcaagtttcctacgaaaaaccaactcttaccacaatttagggccctgagagggaacagagaagttggaggagggggattggctaaaagccactcttcaagcaccgcaggctgtatctccattagcctttcagaaatcttcctcaagaagctggattagtggtaagaactaaaagtctttacataggtgcaaagaatgtgaactatgctgacagccttgtgagatgatgaatatgtttattagcccgatttgttcattccccaaggtatatatataggcacgggaacctcacatcgacctccatagatatatacaatcattgctttatcaattaaaaatgaaaataaaactaaaagggagctttgaggctaccatgggatattaacctttggagtcagatgaggggatttcatttgaatcctagatatgccacttataagctctgcagacttaaataagttgtttaacttctcttagcctctgtcttcatttgtaaaagagggaaagtaatacttatctttaaacattttcataagacaaatgagatgatccatataagatgattagcctagtgcagagcacataggaaatatttagtaaataaatattcacgttgtaatgtgttctgatggcagacagcttattttcatgtaatatgatttagaatacttagtagagactactttatccagaaacatcttctaaatagactccctgaaaagacccctaagataatctgttgcaaagtcagtggtatcgtatactgtagttagggacacaactacctttattcttactaatgtctcagaaatgggaattctcaggtggaaaattgcagggtttgagaagagtggtttgaagcaagggtttcaatgtggagtcctatttgggatcaggcaagttttgcaatataattgctcaaggttgggaggaagggatttggaaggaaactttggagagtaagtaagagttcaatccccccagttgcatggtcttctgttctgagaagggggtttctatcctgaaaaagacgagttgaattgtcagtagttcagatgaatggattttcaggacggctctgaaacagtagagctatttaatctttctgggcaacaattgtttggggtagaatatgtcacggtactctgtatagctggaggtaatttctgttctcaggaatgatagagggcctcaagtccttgtatttattcttactcatatatgtcttatcaaatgtaaaggtggcatattaaacatgtaactgctatcagtcacatggatcttagaagattaactaatctcctaaaaaggctttagagtaatgagactcaatacgtgtacattttgccagagagggaaattttcaggtttatatcatggacatggccttttatggcacctggtataaaatggggtgtgaacttcagcatgcgtaaagaggagtgtttcattgtatgtatgggagtgtttcagagaggcagcaatgtaggactggtggccattttggggtgagaagtcaactacatgccatggggattgaagaaaatggttataaattttacttattttgaaatttttcctttggctctgctcattggtgaagggtatgtgaaatttggatgccatctttgtagggaaaggaatgatcatttattgagcacatactttatgtcaggtgctgagttatgttttcagttcttataatggacttgtaagaatgtttcaattatttttatcttttttatattgctttaatatttacagatgatggaaattcagttcagaacgctaagtgtccttcttagtccattttgtgtttctattacaaaatccctgagactaggtaactgataaagaatttttttttctcacagttctggaggctgggaagtccaagatcaagggtgtggcatctggtgagggccttcttgctgcatactcacatagcagaaggtgaaagggcaagctagcaggacactgtgtgaagcctcttttaaaaggtccttaatctcattcacaagagaagagccttcctggcctaatcatgtcttcaaggccccacctcttaatactatcacattgacaacacctgaactttggaggggacatgttcaaactgtaacattgagtaacttaaccaaggttacacagctagtaaacactagagccaaaagtaaaatgagtaactaggggcccctgaagcttctgttcttcttgttgttatgatttggctgtgtctctactgaaatctcatcttgaattgtagctctcacagttcccacgtgtcatgggagggacccagtgggaggtagttgaatcatgagagtgggtctttcccatgctgttcttatgatagttaataagtctcatgagatctgatggttttataaaggagaattcccctgcacaagctctctcttgcctgccaccatgtaaaatgtcccttgttcttctgccatgattgtgaggcctccccagcctcacaattcacagtggaactgtgaatcaattaaacctctttcctttataaattacccagtctcaggtatgtctttattagcagcatgagaacagactaatacatttgtccgtagcaatagagagccattggaataaaaaaaaaatagatgatgctgatcatgatgatgatagttaccacaggcaacagatattgtacctattatgtaccaggcatcgagccatctactttatatgtattatctcatttaattctctcaacagtctcacaaaggagagatgattactattggttttattttggataaagactgagtgatagagctgtaaagtaacatgctcaaagtcgcacagctagaaagtggtggagcttctggctatatgcaaggatttcagaaaggcagtgacagaaagttgaagggtctgcccacagattaggacatgcaaggcagggaggggtacatgagtttagaagtctacactcatctgcatgtctcatttctggagctgtggctgttaaagcttccaatacgttactttgctgcaggctcctacattttctctgcttaaggtcatcactgctcccaaaaaggataaggcagtccccaaatatgggaaataaagagcagtgataacaacttcctttagttttgccaagtaagaggagcagtgggctgcttgcaggtaaaattattcaggacaccaaccacttttccccgccagcctgtcatgtggccccacattgcccaggagaaattcaattttttgagtcttgaaggtttctaggctttcctgtttagaccacaaacatctttataaagatggttgggatctccagtgccttcacgagctaggcaggtaattcacttctgaaggagctggggttagacaaaaaaatgagttgattactatgtcaacctgtggactgcttgcccttctcacttgccttgacaacactgtgtggctaatagtctgtaggttaccagtttgtaacatcaaaaggatacatttttttttcctcctgattgtcaaagtttgttgtagaacgcgtaaggattaaaactacagaaaactctaaataagcaaatagaatcatcagttgatcctcaactcattaagtattcttgttaccttggcatattcccttccagtttttaagtgtaaaaatctgcatcaatgggatctgcactaaagaggcacatgtgaacctcagttaagaaatacttggggttaaaataaggatatcactaggtcccgtttcagactgagaattagctacaagtcaggcccttggaggatagaacctggagagataagcagaaatagtagaatatagaagggtgaatgggaggtgaggacagagataaatctcctgttgttcatggatttgccaaaggaaaactggccaaaaaaataccttcagcatgaggctggcagcaagggcctgatggagctagggggtgccaggaagcagggtcaatgcttttagggtggggtagaggagagggtgaggtgttaatacgaaagaccctcagaactctctgtccattccatccccatcctccaaccagtttaaaagatactaatgtaggccgggcatggtgggtcacgcctgtaattccagcacttggggaggccaaggtgagtggatcacttgaggtcaggagttcgagcccagcctggccaacatggtgaaaccccgtctctactaaaaatacaaaaaaattagcaaaattagccgggtgtagtggcgtgcacctggaatcccagttatgcgggaggctgaggcaggagagtcacttgaacttgggaggcagagattacagtgagccgagatcatgccactgcactccagcctgggcaacagggtgagactctgtcttaaaataaatagataagtagatagatagatagatagataaataagtaaataaataaataaataaataaatatatatataagtaaatagacactaatctatttagaaacttaaaaaaaattaagcaacataaaaattttgtttcaaggaaaatcttaggaaaacgctgtttatgtaaacagactatagcagagctggtctcttccaaagagggggacttgaagccctctcacatctctcaactctaagtccacccagagcagtattcaaaaatgcacctcatctctgctctgtttgccctggccctgcaaagcagcgccttcctctcagatcttccagaactcctctaagttgctgatcccagtgaccctcatttcattctttgctcttctccacatttgctctttctcagtttgatgaatctcctcttgtcgcattttagatacgtattgacttttgcacaacttcccaagccattctcagagaaagattgacgggtgtagggtcgcgggggaaggaggtttagctattttaaatgttagtaaacatgagagtttgctggggattaacaggaaatcatgaataaaatcattgggatttgataagggatttttctcccagaaaattaaagattttttttcattatctttctccccccaccaaaaaagacatggatgaaggtcactgggataacccattatcaatctaatactcttaaaacagaaaaaagacaaaagtccttaagcttatgctgcccacggggcccctgtgaactgttgttctggcatctttttagcaggtgatactgtcctttaatacctcccacttaattctcaattttcttttaaacatcagatattgaataggctgcaaactccttcaggcaataaataactctcatgctgtatggccaagatctgccaggaagtgaaatatttttgatacaaaagaacaattcattaaaggaggtaatgaaggcaattcaaaccctccacaaatgtatcaccaggtgaataaagctcgtcactctctgtttagggtcatgttgtaaagagaaaaaaacaaacaaacaaacaccaactgcacaaatgggccaaaaaatcagtggggcttagtcaagcctgacaatttagaatttgacaaacaagcagaaaaaaagagagttttattaatattatgaaaaaaatcccctctggaataaagcattacatttccatgttattgtttgcactcatatgcactcacatggtcttagggagaaatctgactttgagatgaaattttgcttatctgattatacctcatgggctctccctcacacacactcagccagaagcacatactgtctcatacgccagtgtgaatggtttcgatgatggagagatgcggtagtgagagaacggagctacaaaatttgggcattctgactgagagtcagcaggttagagccctgcaatgtacctagtccctaggagccaagagggccaggcatctactgggtagatctgaaccggtacatgcttgtccaccaaccctgtagcccaaggagcttaacctgaaaagtagtgtatattaactgttgagagaggtatcttggactgttcttcttcctctgttttaagtccgtaaaatacggttttatgggcggtcccaaacaggaatattgaactaacacagagaagtcaaggagttgaaaaggtccctattagatatgagaaagctccatactaaatccctgctgggtgggcttccgaactttacctgaacattttcagagccctgttgctcactaccacgtagagtctatcctcttgttgaacatccttaactgtgaggaattcctttcctgaattcagcctagtgtattttaatttctttctttctttctttgtttttttttcttttgagctagggtctcactctgttgctcaggactatagctcactgcagcctcgaactcctgggctcaagtgattctcctgcctcagtctccctagtaactggagccacaggtgcaagccaccacatttggcttatttttattttttgtggagatggggttttactatgttactcaggcttgtctccaaactcctggcctcaagccgtcctcctgcctcaggcccccacagtgctggcattacaggtgtgagccaccacgcccggcctgtgatttctttctaacttgatcttggggtctctttcaagagtggctgtaagccactgatagggggtaaagttagttggggtgtgtggaggaggcagcacagcaaaacccgtgaagtaacagaagtgtttctgtcgttacagagccaggagaataagcggagttgctggggagcctggaggtggcagggagctctaacagtgtctggggagagagaggtcttgttgtgggactgggccttttttaaggttcatggcgttatctgtcaggctttcctgcaggggttatggactgggcagtttaaagaaaacgcacatgaagagcaggtcctattcacatgactctggtgttgtccattgggttttactgtggtcagcagatgtgggaaatgttgggttttgggttagtgggatgaggaacaagcaggccatgtggcaaacaaccacgtgggaagggcaagttttctctaggtcagaggcaacagggtatgactgggtttcaagcaacttaagtcatgcctaaaaaatggatgtggaggttacaactatatgaaacaaatttatgagtcttgattatatataaattagcttccattctctttagaaaggacagccaacatatctcttagacatggcagccttacaggtactatatctcattcagcatcttctccttccccacctaacctgatagtcagctcaacccaaatgacaacctccgggtccactgaagttcagataggaggaatggaaatctggtggaaatctctctctgtgtctgtctctcctcccacactattattattatgtttcttttttttctgagaataaggtacagactttcatatactctaattatgaatttcctaaaaacaaaagtattctcttacataaccccagtttatcaaaatctgaaaataaacattgatacaaaactgttagtataactattagatctacagatcttattcaaatttgaccagatgcccaataatgccttttatagcaaaagaaaaaattgtttgctggcccaagatttaaactataattacttattatgctgacttgtcatgtctttttatttccctttagcctcatgttttgttctgctttgttttgcctttcatgaccttgacattttcaaggagtggagtgtaggtcaggtattttgtagcatgtccttcattttggctttgctgattttcttcatgatccaacttgggttatgcattcttggcaggaacactatagaagtgatgccgatctttctcagtgtatcatatcgggtggcacgtgatgactgtcccattactggggatgttaactttgatcacttggtttaaggtgacatctgccagttttcatactaaaatgttattattcccttgatgattaataagtatcttgtgggaaatacactggaacattctcaaagaggtgtggctgtggagagcctgtgactgaccctgcctttccctttgttttcagagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccggtccggcagggaggccttcctggcagcacagggcatggagatcctcttcagcaccacacaggcaggcagcatggggattcactctgcagctggaggccagctgggtgattcctgaaggctgtcatttaggaatcatcccagatagagctgggaacgcctcagtctatttcttgttgcctgctaagggcggatgttctggatttaaggcttcattccaggccaggcccggtggttcactcctgtaatctcagcactttgggaggccgaggcaggtgatcacctgaagtcaggagtttgagatcaacctgaccaacatggtgaaaccccgtgtttattaaaaatacaaaaattagctgggtgtggtgttgcacacctatagtcccagttactcaggaggctgagacaggagaattgcttgaactcaggaggcagatgttgcagtgagccgagatcgcaccactgaactccagcctaggtgacagagtgagaccctgtctcaaaacaacagcaacggcaacaataaaatcttcattccattggttcattcatatatacttaacatatatttgttgaatacacactaccagaggtgcagtgtatggcatagtgttaagtgttgactctagaactagagtactggattcaaatcctagctctagggcctacagctgtgtaactttgaagaagtcactcaacttctctgggccttgaggttcttcaaaaaaaagcagaaataacaaaacctaggttgttgtgtggactaaataagttattgtagaaatggcccgtgcttagaagagtgcttgccatgactgaactgcgttgtgaggatgagccgttattggaataattagcagtggaatctagtggtggatatgacaaacgaggcccttgatcctatagggaaaacctcctagcagaagagtgagacactaagtaagcaaagaatccaatgaggaagataatttcatatcgcactgtgaaatcaatgaagtaagggcataggtctacaggggctgccataggtagagggagcaggtgttcttttagagagagaggtcaagtcatctctgagcagatgacacctgagctgagacctgagttgttggaggagctggtcatgctggtcaggccaagttgcagaggaagagcatcccagggaaaggggatggtgtcttcaagggtttctacttatcagcaccccactggaatatgcattctagggattcctggatttcaacctaaataaattccttaatttcacctgattagggctaattgaaatcctatagtttgaggctacatatgccctccttattggtgatataagtgttccagtatccatcatctgctcacccaccttctcctggggccaaggcagccatgttgcacacacattatgttcctattatctctggattaggccacctctggactccctttatcagccttcttgctcttctctggacaccctccagtttttctctatctgagtacatctgaggtaatgaagccaccaatgagagtgttgtttttccaaccgtggtatctggagacatttctcattaaaaaatggtcttttcccctgctaaacaataacaaaatacagtgctgcaaaccaatatctaactccctatctgctatcacctctgggtttctttccatcattacagctttcaaagcttctcagtcatgaaatagctatattttaccttctatttctcgacatgaagcagggctttgaatttttccaagcttcctcatgctttctaagcttgtggttgcccaagtctctaatccctcccagtccttgtgcaatgccctcctgcattgccgatgtttaacagccccccactctggtccagtgctttaccgtgttcctctgccctccatgttattggctatttctctgttctgtgctaaaaaaccaaccaaacaataaacaaaacaaacaagaaaaacaagaccaataaaggaagaagacagtagtcacagagggaaatgtctacgatagaaaggtggtggagaaaacaccaaatgaagcccagcatgaggtgctatgaatctgtgcacaggttcttcaaaacagttccttatcaggtcagtgaagacttcagttgctcaattaagcacattagcaagaagcttccagccttgaactactgttggaatggaagcagaatgtgagtgcacacagagtgtgcactttatagtgaggtttctctagctcatgttataatctctgcaagtatgatatggaaaagcagttcaggaggggcctatgggatagtgctgagtaaataggccatgacacatctgtcacctggaagagtgtatagaatgtatgggtgtcaacctcaagaggttgaattcctcaccaccaccactcgcccttgcttttagtcttttaaatagtgtgctcttggccgggagtggtggctcatgcctgtaatcccagcactttgggtggctgaggcaggcggatcacctgaggtcaggagttcaagactagcctggccaacatggcaaaaccccatctctactaaaaatacaaaaaattagccgggcgtggtagcatgtgtccgtaatcccagctactcaggaggctgagacagaagaattgcttgaacccaggaagtggaggttgcgatgagttgagatcacaccattgcactccagtctgggcaacagagtaagactctgtctcaaaaaaaaaaaaaaaaaaaaaaaaaaaaaaaaaaaaaaaaaaaaaaaaggtgtgctcttccagagaaaatgttatcaagtttatgtgcaaagtcagatgtttgacattctcctggtttttggaaaatgatcattgcaggtgaaagataggctgtcctggcttagaaaccaaatggcttgttactcttccccccggcagtcataaccagtgttgagtagcctcccagacctcaggtgagtgctgtgagcacagatgcccttgcaggtgtgctggagttacagctgcccatcacccctcctctcccttctgctagagaaggcatgggagtcactggatggccaacttaggggccttggatttggtgatgttatttcagttgccatttgcaaattatgctgctgttgctgctgctgctgctattgctactgccagtgatagtgatgacaatgttaatgaagcagcagcagcagagggaggaggaggaagaggaagagaagaagtaggagaaggagaagacagttactttgaactcttactattaatacatcccttggctgtcttagcaatttatgcagactctccaatattgataatttcaaaagcttttgaggtaggatctattattatctccctttttatagatgaagaaactgaggcacgtaactgttaagtaattttcccaagttcgcaaagctcataagtgttggagctaggattggaatctggtagtctcacctgagagcccatgcttttgcccactgtaccagcagctcccccagttgagcatgcatcagagtcacctggaggggtcactgaagcagagcctgttggacatcaatctcagagtttctgactcagtagggctctggtggggcctgagaatgtgctttcctgacaacttcctaaatgacgctgatactactgatttaggatcacacttggaaaaccaatgtcctaaattaattttattgatgtttgtgatgtgctgacaaacctactgagaatgagactgactgtaaaggaactttttttaagtccttcccacacctttgccatcataatattcttctttgcctttctgctgaggccactgcttgcattgtttctctcttggtgaccctacctctctgtttcctgagtctcacgtttctgcacagattctgtaaacatcccctaaaagttcaaaggctgagatcatagtgcagcaagggtgctgtgtaatgtagtataatggaatcttattggagctttgcatgaggaaagaggaagacggatgacaatttgaatgcaagattgaaaaaaaaaaagaactcctacaaggatgcctgaaacatttggggataattatcaatttggagaaataggtaactgcagaaggaacaaacctatataagataatcagagaaaagaaccactctttggagctacaacagtttaaggggcctgaaaggttgctaaaattggtggttttcaaacttgagcatgcatcaaagttacctagaggaattgttaaaacacagattgctagatcctaccccagagtttctacttcagttgttccgaggtgagatgcaagattctgcatttctaacgagttctcaggtgatactgatgctactggtctgggtacttcactttgagaaccactggaataagaactgatatggccttttaaaagtcacagttgccaccatttgctcagaaagcacagtaggccaagccttgattcatcaggctcctctctggccaacaagaccaatgacctcagccttgtggacctgtgtaaggagggactgaattctaaagagaatattaccaggttggaatcaagaactggataccctaaaggtcagattggtctgagatcatttactatttattcagtaaatgttttctgagctccttctttgtgaaagatgttggggctgggttctatagggggttcaaagatgaaggtgatagaggactcatcatcttcaggaaacttagaatcctatatgggaaaataggatatggataatgcagtgtagccagcaggtgggggtaatagcagactttgtgtaaccatgcagaggaggccctacttggtcttgctgaccagagaagcctccatgaaggcacccacatttgaatgaggctaggagagcgttttgaaaagtctaagagaaacacttggtttgtgaactgttcagagaagcacaggaggtggccaccaggcacagacagagaagctgtggagagcgagtgggacaactaggacgttttggagggtcaggcagaaggaaagatctcagtgacaatccagaagatatcaagccatttccatttaagatatttttatattgaagctacgccacatctgcccttgggcttagaatttctcctctatgttcaaagaatcaccgcaaagagaagggagagaggggttatgccaggcaggagtcgaagagctgctgtgtcacctgagacctgaatagtaagaaagaaccagtgccatgagggtctggagacgagggttccagggagagaaaaagaaagtacatgcaaagaccctcaggtgggggagtagagtgggaggtgggtgagcttgagaaacacagacatggcagagcattgtgagtaagggtggaggcatgagattgagttggagtcatgggcagtgccagggcatttagagttccttgaactatgatagggactttgaattttacttccatcaacttttttttgtttgttttgttttgagatggagtctcgctctgtcacccaggctggagtgcagtagtgtgatcttggctcactgcagcctccgcctcctgagttcaagcgattctcctgcctcagcctcccgagtagctggaattacagccatgcaccacaatgcctggctaatttttgtatttttagtagagacgggatttcaccttgttggccaggctggtctcaaactcttgatgtcgtgatccacctgcctcggcctcccaaagtgctgggattacaggcgtgaggcaccatgcctggcctccatcaacttgtaaggaggcacgaaggagaagaggacatgaattaaagggatagggagggccagatcacatagaacttcctagggcacaaaaataaattagaattttatttctatcaagtttgaagcaggagactgacccgatacagtttatgtgtttcatttttttatttttgaaaaattttaaattaattgtagtaaaatacatgcaaccaaattcaccatcttaactgtttttaagtgtacagtttggtagggttaagtacattgttgtataactgtcactactacccatccatctccagaacccttttcatctggaaaaattgaaactctatacccattaaactgatttatgcttttaaaggaccattctggctgccatttggaaaagagattatcagagggcacaaggggaaggaaggagagtaaggggaggaattagagtgttgataggagtgtaggcaggagatgttcgtggctttggctacatagaagcagagctggaatttaaacccaggactttatactcttagtcaaggtccttttccactaaaatgccttgctttgttatcatgggaattattactaggactctgctctgcgtagcagtgactcctagtattctcttgcagactcctaggagactttatgaaactaaggatgccttctctcttcccactggctaatactaaatgcttactattcggcacttgcctactttaatgcatttaattcacacacaacattaggagagaggttgtgttattatctccactttgcagatgaagacactgtggcacagagaagtgtattaatttgccacggttatgaagttagtaatctttagtccaggatttaaactcatgtagtctggctccaggacctgagcagtttgctcttactttaccttgcctatgtatcatgcaagtagggtatttattacgccaaagcgaattcaaagatgttaactgtgacggaagcattgaatgtattaattgaatgcattctcatatttcatcatcccttccaagtagcagatgtgttattgagagtgatgggaaaagggagcctaaaatctcacctttccctccaattctgagacattggtccataaggatcctatttcctggagtcttgtctttttttgatgcaaagcacaagtaccagccctgcacttctaggagcctgagagcaagtgcttcctgggaacctccctttcctcaccttagtcttggctctgcacagcacctttccatcagcatgagggaaatgttgacaaaggaattcaagaatttctgtcaccttgaaaccaatgatctttgcattcataagtatttcccctacagtgcagcagacagcaaatatatcatgattcctaaagccttgggttttatagattttaatactccctccagccttcaaattcagttcgtggtatggcccaatttttcagaacatttgaacttgccttcatcctttcacttgttccattccaccaacaaaaaagacatgattatcttttattatcaaagaccatcacaaacatacctaggttccaaaatgttggcttttttgactgaattccctggcttgggctggctctatctctaccaaggttggagcttagaatattatatctgataagccatctctttcaccttcttgcttcctccttgagactctgttttatttttttcccattgctgatacttttcatgaaacacttgagaccatttgaccagaccaaagggtgaaatagcttcaactgttcattagcctccataatgaattagccaaaactaattcattttccaccaagagtatttcctgctgtgtatcctgaggctgttgattcagaacacctgatgggtatgactggcacacactgaaggagagagagcactcttgattgcattaagacatttcattttgaaagctggcttacttaaggctgggcgtggtagctcatgcctgtaatcccagtactttgggagactgaggtgggtattttatcctgaggtcaggagtttgatacaagcctaaccaacatggggaaaccccgtctctattcaaaatacaaacattagctggtgttgtagcaggcatctgtaatcccagcttctcaggaggctgaggcaggataattgcttgaacccgggaggtggaggttgctgtgagctgagatcgtgccactgcactctagcctgggtgacagagtgagactgtctaaaaaaaaaagaaagttgacttacttatattttggagtcatttgggtagcttaaattcatggaaaaatttttattaatttttttcctccatgttctttcacatggaagtacctgtaatgttgagtctggagatgccatagttcagcagcaccacggacattcacactaccctgtggtgtgtacctagcatccaccatctccacttctgtgacttattggcctcagagctttctgcaccctttaggaatagcaaactgggggaccccacaagtcatcttcctgtaccaagtcagtagacaaaacatttacaaagatactgaagaaaatggttgtgtttttgccaaagagatactgaactatactcaactctctgtctctcaatttagtgaacttgttcctacatttttcacagtgtctgaaaagaagggtcttgtcatgttccatcagtatcaaaatgttacatctgcaaacccaatttttctctgatttgggaaggtaccaagagggatcaacactgtgggctttgagaagaggcatgtaatttaatttaggtacttgggattcacttagtctttccttctgatttcatattttatcttttttaaaaaatatttttctccacagaagacagctgaaagagaaaagcaaaacttccatcaattcagctgctcattgcctaacgtaggcaataattcacagtgacacatgggtggctgagaaaagacaccggcctcctcttcccccagctatcctgagcaatgtcttgccttaggcgcagcatcccttgaaagaattttaagtctgtattcagactgaattcattgcagtgatgtatgaaatgagcaagagacagaaaagtgcagattctacattagacaaaattctatgttggaatgttcaaatttgacattctacattaaggctgtttacggtctgtccatgcgtataattcattagctgaaacacagctaggagactgtgctgtgttacagcttggagagtgttattagctgtgttacagctaggggactgtgcccagatgttggcatctgatataatcttccctttgctcagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaaggtaaaataagttggtaactatgacctttaagatgagtttttgcattttgaccatgtttcccaggaacatgggtgaaaatagaattcgttattttataggtcaaccataattgtctattaagctaattagagacatatatgaaaaagcagttttgattttcataaacagggtgatttcataaacagaaaaaaccaagctcgcttattttgttcttcattattaactgtttctgctttgcttggtagctatcaaatgcctgtacagtcatctcagctaattttaaaaaagtctatttagaatcccatgatcgaatctctgcagcatactgactgtggaattaatttgccctaaggatgaaattgaaataaaactcttgttatttacaactgcaggctagtcatattggaatatttgaaagtattattatttaatctctgggaagatcttcctgtcaaaagatcctagtacgaacagattttctataggcataattttgccacaatggtacaagatgccttctatggacttttgttttaaataacttcctcaatcaaaaaattaggggctcaatcaaggtgatatttaggttataacacatttcgtttgtgtgtgatctctaaactttggctacactagttgcataaatacctctaactttcatgggagaatccagagtggtattcatgtgtcattttttctgcacttattttgcattcaatgtgggataactgtttaaactttatgacttagtgccccgacatgcctacatgaacaccatttataccgaccaataagcatttgtgtgtggtgggatattgtgcaattaatattgggccccttatttgagagaggaagaagaaagaaccactgtatggtgaaaatctaaatcctaaatcccgggcaaaggggaaacttcacttatttcacctctttttccccatccagaggattttgaagatgatggcgatgatgaagtggacaaagactctgatactgaagatgggaaagtggaagtaggtacaccagcccatgcttctaatgatgtccatagtcacatcatgcacagaaaaatattacttcctgtgtttgcccaagcccagtgtaaattttaagaactgactttagtactgccactccagtggtcgtgatgcgcagtaaatgatagctactgttattgatttccaagttgtcattttcatcttggtaggtccggtacaatgtctcattataaagtcagaggctatcctatacattattatgacaccaatactttattcagatgacctttaggcacacatttaacacttggagttggtatatttgataagaccatttaagaccctagaaagattttccaggaagctttctgcctttgtaagtcactcttcttatcctttctgcacaggggtgctgcattgtacaattccattgacatcagactctgtgaattgttttcccttaagttgcacagtgcacaacctggccagcagagaagtgttgctctttggtccccctcccaaaaaggcctattctatagaagagaggttggtgaacttcctataaaaggtccaatagtaattattttaggctttgtggaccatacagtctttgtcacaactgctcaactttgctgttgtagcacaaaacagctatagacaatttgtaaacaaatgggcatggctgtgttccaagaaatttttttttttgagacagagtctcactcgtgtcaccaggctggagtgcagtggtgtgatcttggctcactgcaacctccacctcccggatccaagcaatttaccaacttcagcctcccaagtaactgggactgcagatgcctaccaccacacccagctaatttttgtatttttagtagaaacaggatttcaccgtattggccaggctggtctcgaactcttgaccttgtggtctgcccgcctcagcctcccaaagtactgggattacaggcatgagccactgtgcccagcctccaagcagtctttgtttacaaaaataagcagtgggatatagtttactgactgtttttgtacaacaagttttctagaccttggcactgttggcatttagaccggttacttcttggttgtgggaggctgccttgtgcattgtaggatgtttagcagcattcctcacctctacccactggatatcagtagtacctacctcattaccctccagggatgaaccaaaaatatctcttagacttgccaaaatcacccctagttgaggactactgctctagaataagaatttgtctgtgaattataattctatctccatttctgttggtggacatggactttgacaaattcctttaagttatagtttcttaattttgttgtctgtaaaataagagtcagtaaattaaggtcaatgctgccttttatgacatttactggggatgaaactcaaattaaaaaaaatcaaaaatcttccctcctttcctttctctccttctttcctatctgtctagaaagaaagaggcttttgagttctctgtcatgataatcactcaccctgctgatggtagtagcagacatacagggactacctcttaagctacatctataggtttagactgctattgacagtctggtgttctctgggttttgttgataaatagaatcatttctgaagtcatccgtagcaaattggatctttgctgtggcttgatggtgcaggcctatggagtacgtgctgaattatttgaataatactgtgctgctgcagtcattcatcaatgccactttcccctcccctcttgcttgctctttgataactgaatgtctgatgcagagtgtcacccacttcatgtatctgatggggagggaccgggtgcacgatagtgcctgacttcccacagcatgggagggagggtgttcagatagttcccttggcccacgctttgcagaggatggaggggtggggtagagagaaccctaaacaaataaataaactcaactggcaaagaagcacaagacaaattggtaagagcttgaaaactattcttcaaaaggcttcaagccaaggcaagaagatgagaagtcagtgtgaggatgaattgtagagaaggagaggagcatgagagtcagggctcaaattggaggcacagcaagagcaaggaaactgctccagaaaactggattttccctggggaaaccagcagcatttgctgccagaggcgtgaacaagaagtcaggcatattttatttctggccacagcactgatccaggcctttaacctgtggccttcccatttgacaatcttaggtaataattgggaccagcctgttagtaagaatgattaagaggatcttttatccataaagggctatgagagtggaaagtagggtgccatgatttgattgaaaactgccaaggtcaacgtattagatgtgggctgtcttcacatacacaagcattagattctgacaaactctgaagaggagggtgataaacagagtgaattcaagctctcccttccttcttccttcctttcctttctttttaattttttattctttcaggtgctttattgggtatgatccgtatgcaacatgctaaattcttggggatgataatctgaaacacaaacagataagacatagtttttatcttcaaagagttcacagtctagtggacttggagtttgtccttattaagtgttctaatcaccaccttcaatggagtggtgaactcaagtctgaggcagccaaaagacaatgtccaaaagctccaacctatggaacaagagccagaaagcattacctggattaggtgggtaccagaattctagctggtaaaggactgcctgggctgctgtgaggacacagaagcaggccacctccagataagaataaatgccatttataagaaatacaaaaggaggtggcaacctggctgagtgcctggttctcagagactaagctccagaactttgaaggcagaaatggtctctgtcacaactattaaactttgctgttgcactgagaaaacaaccatgatcaaatgaatgggtgtggctcttttccaataaaactttattgacaaaaacaaccagtgggccatagtttattaacccctgctctaaggctaagtgggtcgcctagtcacatgtggaatgaattaggttgcagctcatgggttgaatgactctcctcccttcagatgcaccagttggagcacagccttactcactggtggggacatccttcccagtggccttccaggttgtgtttcccttagtaccaccctgggccatggctgaggttgcagtggagggggtgaaggcaagcaggaattgatggatgaagctgcaaagcacaagagtgggggccatggagttggtcatggtgtgtatactgtacctgaaaatatcattaaatgaaactcatgggaattacttttcttttaatttgaagtttggagaaaaattgtgaaacatagatggaacattgcatttttttgccccttggatcagaaatacaaacatttattttccacgtttattggatttaacctttcagtactgccaggtttttccttaactaatgaaatatacttgtaaaacatatggtattttttttttctctatttcattaaggaaacttaatctaggatatgaaaagatgaagagactgggctggttcattcctggtgtcttttctctgtaagaccctacaacccttggaaaacacacaagtattcagaggagagtcaccatcatcattaaaaggtttcgaaatggtgatctatcaagaataaacaataaagtgcctgggattattcagtccaataaataaaagactcacggtgccttggtaaatttttaaatgtacaaagggataaagatgtagtaggagaataccagctcctccccaggtctcataaggattgatataatttctctcccgcctacttctcaaatctcatctcctgcaatcttcctcttattctgtatgcaacagccaccttctttctgtaagcaaattgaagcttttccttctgctaataattcactgctaggcctatgcatagctggcttttttttttttttttgccatttaggtctcagttaaaactttacctccttatgagtcctcctgagatctcctaatccaaacagcctcccattccccagtcttagtaacatcattctcttttatcatttcaagaggagttataactgttggaaattaacttattcatttgtttactttcttctttactgtttttcttctctcgctaaaaggcaaataccatggaagcatggatgtttgtctgttccattgtgaccgaaacttcagtaccgggaagagtacctgctcacagtcggtgctgattaaatgtttgtgaaaagactgacaaacctaaatgtcaaagatagataaagagggacaataattacaatgatgctgacgatagtggcaatgagataaagaatttcttttataatgtgctttatcaattatgtagtttatctcattttatacaaatttttatttctgatgaaggctgataaatactgacataaatgctgagacaagtcctttatcttctttctttttattttaaaaatacaatccagcataacaaattcttcactggatgggccagtgctataatttggaggcaagaaaaccatgtcctaagattctgaagaagcacatacatatcatgtcttgatgcttctcagggtggatttcctgactgtaatctcttctatgactattccattttaggatgatgacttggaaacagacgtgaacaagctgagttccaaacctggtcttgaccgacctgaagaggaactgatgcaatatgaggtgatgtgtcttgagctctcctatagctttgaggtaggacatatgctgtggttctgatctttgacgatgcatgatgggttctttgcagatcctgggaggccaaaccagggtgtccagatggaaagcattgctcatcattagccatatgcttctgggctcttccttagagaaaagcagaatgctaaacaaaagtgggaaaagatggcaaaaatggaaaaaagttacgatgtatgcaagagttcttcagtctgacaccttacacttaggatggatacaaggtcatgtgctgcataatgacatttccattgatgacaggcagcatattccttgatggtcccataagattataatactgtattttcactgcacctttttatgtttagacacacaaatcccattgtattactattgcctacagtgttcagcactttaacatgctgtacaggtttgtagcctaggagcaacaggccacaccatatagcctaggtacaccgtaggctaaaccatctaagttggtgtaagcacaccctatgatgttcatacaacaatgaaatcacctgatgatgcatttctcagagcattccccattgttaggtaatgcatgactgtagcatgaaggtacacatcactgcctattgtctggtgggcagggtgccctgcccccatgcactgaaaaagcaaataaaaattcatgatgatttaattgttctcatgccaaagtgggaccgttgtcctagatggctttttgaaggtggacatactgacttcaggctttcttttttaatagaaacaaattgggaacattagacctggtgatgctaattctgtgcctagttgctgctgccactgttgctgccatcgatattttagacctgctttttgatctccattattttcttatggctcttagtaatcatgaatttgcctacatctaagggtataagctaagtcatgtgtacagagggagttaatatattctatttggcttcagaaagcagaaggatggtttcagggaaggaaatttcagtttagtataaaaatttttttcaaataaacagaattattctcaagtgaaaggcactgccttggggtgcagtgaggcccccataaatatggttttccaaccagattgtaatttagtagggggtcttgaagacattcaaatactgttttgcattggactagacccaccaaaagccccttccaaacatgagtttctatgattctgtcatttatttgactcttgaaggttagtctttagttgaccttggaaaaagcttccacattcacaggatttatgcttagctctgtgcccagagagtaaggacagggatcaaattgtattccctacctggaaggacacactaacatattgtattccattttgaacctgaaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggtgatggcgctactgacttgggagctctttttttctgttctttgataattttataagtaaaatggtttgtacagataattctactatctataggaaagagagcattaatcaggaacatgtcaaagcctgttggcaaactggccaaacacacaaactttgcttcctgcaaggacttttcagaatcaagtgtggggtagtggtaggcatgcattttctgatgaaaaattccttgagtaattctaatacaactccttatcctatctccattgcaaaccactatcacaaagaaagatcatccagtttttccaaatactgggctccttcctcaaaagtaggttttcaggaaaatcaagagctgattatttgggatctcttttcttgcttcctacaaattgataggggatctcttgctaatagaaaggaggaggtgtgcctccattccacagccctagctattatagaccctggcttagttaggagaatagttttgctgcctcacagagctggcggggagttgatggaagagaaattctccagggaagaaacactggttgatagattattcccagaaggcaggaaagggagctttacccatggctcagcatattgagattaaaatgaaaactgctaaaggcaaagaaaacattattctccttgaaaaaaaactgtatgcacataccaagtcaatggagcaaagtgggcagaccagaaagttttcttattatccacgtcatctgtaaattattctcttgatggtaaatcccccaaactgctcccacttggggtcctggctgacatatccaaccctaccccctgcactttatctgtcatgctcattttttgagaaacagatcacaagggctgttctagcaccatgttatccctgcataggacatcttccctctgagtccaggcctcatgtccaccttttcttcacccttctctcacacctcccttatgaactggattggaaattcaggaaggtaatctgaaagaccttctaagctttctttctctctcttagttaaatatcccagattttggtgtttcttagaagattgaccttagcctaccggagcagacagagcccaaggaatataaattgcacaagggtacacaggcttattggatcctcccaaaccttgaagatgctagcagctaatagtcctaatgtcttcctcaaaactttctcagtgcaaactaccctcttattcccacagctagaaaagttccaaagtcccccaacgcaagtgcttttgataaaattcttcaagccaagaattctctaactgaaatctaacatcactacttcctacattcctacttcttatgcagttttattttttgatagaggcagagaaagaagaagggcagggctatttgtatgctctgagctcaaagttgaggtgttattaaacttctctgtgctttcatatttttctggtgacccccaaagttcttcccaggtgatcacaggatgagtgagctagggagagaaggccgacccttaaaatgttttcaattttctttttcaggatcaggatatttgaggatattcggaggctcatccagccaagtgatgttataaataaagttgtcttcagtttagatgagccttggtaggtagtctcgtgcatctgaggaaggtggggcatggagaattctcttaatggcatgagaatagacatgtttcctgttaataatccactcctcctcctaaaacagcatgatgaaaatccaggttaaagatctataagagaaagcttagctttaagaatcatcggccaggcgcagtggctcacgcctgtaatcccagcactttgggagcccgaggcaggtggatcgtgagttcaggagatggagaccattctggctaacatggtgaaactctgtctctactaaaaatacaaaaaattaactgggtatggtggcgggtgcctgtagtcccgctactcgggaggctgaggcaggagaagcgcttgaacctgggaggcggaggttgcagtgagctgacatcccgccctgcactccagcctgggcaacagagtgagattctgtctcaaaaaaataataatgaaaaaaagaatcatcacactgttttcaaagagtagtgataacacatatgttcacatgttccttatttcattgtaggcctttgcaagacaatgcttccaattgtttacggttcttctccaaatttgagtcaggaaatcttcgcaaagccatccaagtgcgtgagtaagtaaggaaaaccacagtgggtgtctcctgtcagttcgtaagagcaagctgtgactatctcttccccatgctctgttcagtgaccttgcattggtggcttgaaatcagccatggtgggaatatttatatcataaaaattggcaaacagtacgagtgaaggtttttcctttcagagagtcatttgttaaacatttaccagtacaccactaagtgtactgatatcatagctacactgatatcatagctaagtgagccattcagtagaagtgaactgttattaatgtgtcttgtgtttcaaataatgggtccatatttcggtgtgagagcactttgactgggatgtttatactttgatgccaaggctgattctgttgaagggaagggtacatgggcttgctattcctgcacttctctatgcctgttgctctcattcctgtgtacttaggtggcaaaaatcatgagcttcccagagaaaggtgaaccatcctgcattcaagggaagatgcagtaccatgcctctctagcagaacctacagatgagctctcagtagaaaaggatatcctagccaaggaaagcctagggctgtacaaactaaaagaaaggaaataaaacacaaatgaattttacttctttttcagtgtcagaagagaccgcggttctcactatgttaaaattctttctattatagcagtgtggatatatttcccatataccaaaaggcaagatacatgattcatcttctataggtgaacttctgaaaaaacagtccagaacagataatggtgtggtggccatagacagacatcagaatcagagtgccagggtaacttcatcaccttccaaccaggagactgagcaagtttcctaactcacttcatgcctttatttcctcactcacaaaatgagaacaataatcgcacctactactttgggatttcatgagagctaagtaatacacttaagtctcttagagtagtacctggcgcatggtcagcacttagtcaacatccgttcttactcagggatgcatattcgccattgttggagctcagaattcagtatagctgagacctccctcatatccacctgatgattcatttttgaagttcttcctctttgggggaggtgaagggtgatttttttttttgtacataaaatatttcaaggaagcccaacaaataaaacagagaccagtttaatcaggctgaagacgggaaagacagtcatgtcaagactctttctcagccctctttgtgttgttggcttagtttccacttcttcctgtggctcctgcttttactatttcttctctccagatatcatgttcaaaggatccaggaaaggagacctgattatgagtctcctggtggaacagttatcagatcaggatgcggctaagctgctggcccggctcaggtctttttctctatacatttcccttggaccagagtctaaaatcctaaattcatcagttatggtcagggtaatagagtcaaatagcagaaacaaacctacttatgggtaaggaattttttatgattactttttggagagagcactgtgggaatagcagacaatttgagggtcatagactttccagaattgttcttgtgagtgccactccatggggttatgtgtcatgtgttgtgtggtgagcccagtggttagagtgtggtgcccacagagacagtgtgaggactagactccatcagatagctctactctgctctcatctgtcttataccaagctcagcgtttcataaatctcacacaatgccatttaccaggggtccagtgtgggagagtatgaatggattggggcaaaaacattttccttttcataagagcaatgcaaagagaataccaagaggatggagcaacatttttaaaaatgaaatatcctgataatgtttaagtcaaaactgcattgctagttctgttgctagagatcagaaaaataataatctttggagatatatagtgatggggagaggatccctgagggcctcctggggtgctggaaatgtcctatatctgggtagtagtcacacaagtggtttcagatgtagataaattcatggagctgtatatttaagatgtgtgtattttatagcatgggagttatatcacaatgaaaatgaaacaacccctgcattgctagcctaattcatgtttgttgttttgctgggggatgtatatttactaggttatttgatttttataaacagcacctcaagtttagacacttccattttccgtatgtggaaattgaggctcaaaagtaacgttgatctcaaatagcaatggcatatccaaaccagatgtgattgaattttctctggtatatagcacacttgcattttttctagctagataaaaacttcattatagtttaataaaaaggtgtgctaatatttcaaaatagtaaaaagactagaattggaatgttcttaacccaaaaagtgttaaatgcttaggtgatagacatttcaattaccctgatttgatcattacacattgtattattgtatcaaaatatcacatgtaccccataaataaatacaactattgtgtatccataatagtttaaaaaaatttaaaaatatgcgctattgtgtaattgactcttgtaatactaggaagccccctcacctccatgaatttccaaaatctgtacccaatattgtggtatcaggatgataagtataacttaccagctggctgagatcctgggtcttagatctgtaacccagaaactgaaacgtgtagattcttagtgtctgaagtttacctgaaagactttccagataaccctccagtcttgcttctgatctgcaggttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatggtatgaacgcttggggagcaggggctttctggaacatgccaggaatgacatttcttgactgtttggattcaaagagcctttgcttgggttcagagggtttgaagttgggcagagttttgggttgccaggtgcagcaaggcaggcagtggccctcagtggcacactgctactttagaggggaggctgggcaccctcactctgccacacattgacatccactgcttctggattccctcgctctaccttgaactttttgaggttggtgagcgttctcatttattccttctctccatctcctaagtcccataggagcaaatgctttgacctgctttttttcctgcaaggtagaggaacaacaaaatccaattggacaacactgatttacattcttagaaagctcttgaagaagtttaaattctcctgaatacccgtggccattttggaggagatattcaagagagaaaggctgacgagcaggctgtatttatttcaaatgttttgaggaatggaaattctgcatacaactgctgcatcatatactaacttgctgggtggctttgaatgaggaagaagtattcccaggtgtctaggtccaagtgcagggtactgtctctattttgtagtgactaaacagattcctgtgggtatgagaagagaaaatatgaaccttgacatttatattcactttgtatggctattgtaacaaattgtcacaaacttggtggttgaaaacaagacaaatctgttctcttacagttctggggttcagaagtccaacatcagtttctctaggctgaagccaaggtgttgggagaaccatgtttcctctgaggattccaggggaaactccatttcctttcctttcccagcttctagagtagcattctctgcattccttggctgatggccccttcttgcatcctcaaagctagtagtgttgcatcttgaaatctctctctgcttcagtcacgttgcattttttttttttttttttttttggcgagacagagtctcgctctgtcacctaggctggagtgcagtggtgtgatctccgctcactgcaacctccgcctcccgggttcaagcgattctcctgcctcagcctcccaagtagctgggactacaggcatgtgccaccatgcccggctaattttttagtagccgtgttgtgtttttagtagagatggagtttcaccatgttagtcaggatggtcttgatctcctgaccttgtgatctgctggcctcagcctcccaaagtgctggtattacaggcatgagccaccatgcctggccacgttgcatctcttctatagtcaaacctccctctacctccctttcacaaggatatttatgattgcatttagggctcaccaggataatcaccccatctcaagatccttaacttaatcatatctgcaaatctctttggcgatatatagttaacagtcacagtttccagggattaagacctatgtgtatgtgggggtcattatttggcccagaacaactctctttccctcatggattaattcctttctgattttgtgtagggatgcagcccaccctatattctgtgaaggaggctcttcttggcaaacccacctggataaggacaggccatgaaatatgttattacaagtaagttagagcgctgttagcttccttttctctgtcctgtaattttctctcaatttcccacttttccatattgatcttataaacatcagcaatctgtgcttgtctgctaaactttttgtcactctgtcctaatggccagtgtccggcccttcagagatataagcatattcactggcacgcacagtagacctcgagaaataccttttgattggctgaaagagtttatcttcatttaaacacattaaaacttttagatcttgttgtcagatattagaagtcatagagattctacctgtgattagtgtgtcaagccttagttctttacttatttccgctgaacccagagagtgaaatgtctgagatgttctatcctgtttctatccaccccgtggtttagttttccaaagtacaggagggtgaatatgtgacaattacacataagtaactcctccccatagcaaggtaattttgtggaaaaaaataaaagagggaggagtttcaaaattcatcttcaatccttgatcagtcgccagtttcatcagtttatcctgcaaagttataatgaactttaaattgtccatatattttgatgaaagaaatgcattccagccatctagattgcttatatgtacattttcttcagatgaaaaataaaattcaaatttataagaaaataaggatagggattgctatgagaggtagaatatatataattaattattagttcagtgctagtttcttttaaaaactgagagactagtacttactttcttaaataaagtaagtttcatctctttctgaaattactagcggcctctaaaaaagtatgatcagacattctagagtttgggatagttgtcactgtggaaaagaaacagagtatatacccttatgcctcttggcttttgagactttgaagataggagtattgatagatgggaaaggtcaagaatcttgttgctgtatcagatacaaaggcaaaaatcaccatggagataatgacagtctataagacacagagccaggctgactagcctgtaataaaagagttggaggtattcaatccctgatctattaggatatgaatctaaagaggatttttttatatcctttagaaaaattgcacaatattatgactttgttggttttccattcacctaaatggcaactactctctggctcacctatcttaagactcttagggcctttcctacggttcagagagatttagattaaaaatcacctcaaggtgatagtctgtaactgcaggaaaaaaaaatgaaaacctacttttggaccttggtgtgtcaagaatgacttttagttttctctgaaaatagttattctcagtaaatctgaaagacccagcttagagctggcttggacctgaaagttagtaacagattggacaaacataacatttcctaatgggatatataaattccagttgaggatgctcctcttggaattggggagtaagaaggctaaggggaccacgtatttcccacaagagggaagaagccacactttcaaaagcacagccttgacctaaggagaaccaatgctgatagcttttagagctattagcaagacaattactatgtgattaaagagcaacagagggataagaaaaaaaccatgaatgtataatataattcatttttcatattccagccatgaatacaacagagatgaatggataagattgctacattgtaatgtagtttgttttataattattcaccacgttgtgttaacatattcccaatactgtgatgtaacaacagggtagatatgtgtaatctctattcacccacaaattagaacgcctctctcaattgtaaaatgatgccttagattatgcaatatctctctccctatttacctatcctgatttttgagttgatttgctttagaagagttctttgcttctctcctgcctttattatctctggtatattaatttgggagaactttacttccctatttccttgtctccaatatatctttagatactctgctctatttctattatgctgttaaagtcccagatttggtgccatgttttaagaggatgccagggtgctcactgtggggacaactgtgagccgtggtacctgagtatgtttatagaagggtgaaaggaaaaaggagactcagaagaaatgggatttgcatttgcattttctttcagaagttgaagttgacagcaatgatgagcagttaaggacatgggctgactactctgtagggccaatcgtcatcaaatagtctccaaactattttgacaatgtgccactaatcaataagatatatttgtatgtgttcttaccagattagtttatacatttaaaaaagtgtatatgcattactatactaatatattatgcacctaagaaagcatgtaaaaaatgaagagttttaaattaggaaaaaaagatgaaataaataatagtttatatctacctaattgttacatctttatgctatttatagcttagggcacactagaattttgttgtggagtttaccattagatgtagttataaatagtctttttggtaattttgagaaattttgattaactttctagatctgattagattattttaacaaaaatgagaattaccgagaaagacctaatattaagggtaggggtaggctatgtccattctgccattttatggtcattttgattgcaatttaattttatcatcaatagatggcttctaagaagatttttctttaaaaagtaattgtctagtttgtgaggtttagtttaatttaggtaatacaatctgtaaatgaaagtaagcttctgtaaacttaaataccttgccggaagctaaaagcaaaagaaaaaggaggggagctagctgttcccacttctccctttggagacctctcccatgcaacaatcgatgcttaactaacatataaaaaccgtagatgcagaatataatgtgtttttcatactccagccctggaatacgacagtgatgagtggataagattgctgtaccatcatctagtttgttttataattacccaccacattaggctgacatcgagacagccatgccaatccccatattaaatagtagacaacttaatttctttcttactatctagataataatcattttaaggagaaattctaatattttctgcctgtggtcagttgatcaccctgcccctcccctggagcacctcccaccccttctattccacctcctgctcttccccaccttgatgaccactaggctggaaaataaaaaatgcccctcgagagggaggaacagaaatgggcagattcatttttccctgcctctcgtaaaagtaagcaagggcccttttagtttctttttttatttagttccctgtggtctgcttcttcctctgatgtgcacagccacacacctttttgaattctctcccagctctggtctaaagtaattttggtgctgaagggcagagggagggaagctgtgcgcttagagtggccatgtaatacacaacggctgatctcttctgacatttatctccgctcgtgagaggagatggaacagctcactcatgaagatgaatgtcatacaagagctctgccatcatgcatccttccatgggatctcaagagagagatctggtattatatagaatattagaaatgctgcagacacagggaagtctggcaacttcactgctctgccttattagatcctgttaaatgaaatgatacacccttgttaaacagagccattgtcattataagattatctaatccattctccatcatggcatttgcttattttatgcaccctgctgaaaagaaacaatgactttccagcatatttttaagtacaaatggaaataacctgagttcgtaactatgcctttgtgtacttgctccttgcttcattgaagtctttatgattataaaagtgcagatccttccaaagataaatggttcaggcaatggaaaggcaaacaaaaagccttttagctgtgaagttgctggatgtacccagcccaggtcatttttgaccccagatgaccaataggatccagctaatcttcaagatcactcctgattttcaccaggctgcttctccatctagatgaacagattgaggagaggaagttctttgactcaaacttccaccactcattaatggcgtgaccttgggcaaattataccaacttctttcagattcttcatcttaaaatgggataataatggtatctacctaatagaagtgttctgaagataaaataacatgagataaaacacgtgtaaaggttagaacagtgtctagtgcatagtaggtgttcaatgaatgctagcaattatttttaataattagtaaaaacatcttagtggcatcaaataccaatgatataaaagtcatagtatatggatcattttattagctctcatcttgattattttacatttttttctattattttagactgtaagttcataggcagctctgatttatgaagatcaaaacttcagattcttacttgctaccttgggcataagacatcttgtcctttttaacccattcctaagaagcagatgatataataaaaaaattttagtttctgagctaagcctacaactggggttgaatcctgtttactatacttgttgtgtggaattgctctagacacttaacctctgtgagccttaattcccatgtgtagaatgtgtgtaataatactcaccttgaaaggatgtcattagaattggagataatacattgaacaacctaattattactcctggagtcttgggtccgtgtattatacaaactttaactgaacagctgctatgtccaggcaaggtgggaagcataaagataaacagatgaataagcatggtccttgccataaagtattggccatgagaataggagtgataagggggctatcagggcaggcttcctgaaagaggaaacacttgagttaaatcttgaggagtgaagaagacttagctaaataaggaagatggaaagggctttccatacaaagcaagaacatgggaacaatttaacataggaaggatgaacattgcttcttgcaaacatcactcgatatgtccacatcataactgggaaacgaaaagaacttgttgatgggatctcagtttatcatggatgaactgaactgtagcaagccaggtgtttcactttagagatttatcaaacatttggctttgaaggtcctgggaaagtttaaaggcctctgcagaggaaggtgtgctggaagcagagtcatctcctggacaactcctgctacaaggtggctgccaggagagtccagtggggatgcctgacatttgctttaggttcagccagagtttagaccccagacaagggttgtaactgaatttcttttagctgaaagtcattctaaataaggtgtttataataagattttttttttttttttggaattccagcagtgtgcaaccatcctggagaaggctgacttgttggtggggagcctttagtcttgctcgggagaatctaatatcaccaagctatggggggtagcatgttaggagagagagagagagtgtgtgtgtgtgcatgtgtgtgtgtgtatgtgtgtgtgtgtgtgtgtgtatgttggtggtgtgagaagacagatttgacatagtcagaactaccatttgaattccttacacttcccttaaatcttgagcccatggaagctcaagagctaaggattagcccattttatttctctttccatttcactgcagctgttttttccttggagtccaggttttgcctgaatgagggaaagaacatagagataaatacatggattttattttttctctctctttcttgctgtctcctgtggttgaatgtggtgaggttgagtttgcataggctaaatgtgcttgtgatgtgactttagtgtactaatagtgcagtggggaacctaaaaagaagcaaggcccatgccaaataagaccaaccctactggcccttcgggacacctattatttttgagtcaagatacaggctctgtctccaccatttgtaggtgaagaactggggacagtgaggcacaaggtgcgtgtttccatctgcctttacattcatgaatacatgcacatctgtgtgtgcactcacacatatgtgcttacaagtgaagcactcttccacgctttgattggttatccctggatcattttatttcaactgctgtttcccgtaaagaggagtaattgactagcatttgttgttcagcaaggtgtaaactgagtgtatgtttgcacggaggctttacaagggaaatcagaaagcaaataagaggtagagcatatgtaacttgcatgctttccgagctaccatctgcttctttacgtactttctaataaccagagtcatagcttttggagaagcttcagaactttggggcaatctggcaaagtagacctaattagccattgcgatccatatcacaccatgtgggaagacactattttaaaatttctatttctgtgggcataaaggaaacggattctattaatacaatgccaaaaacctgggtgtgacagccactgggggcttatgttgttacagggtaccctcctttccctagcatgaccaaggctccagattgccatgttggcagaagctgagggaaggaagataaaggtatcaggccatagtcagtgggctaccagcttcccttagtcccattccgaggtgtataaatattgaaaagccacaaaaccatgagaaataaaaaaacagattttctatctctttcttccatgcttactttttgcttaggtagggagtggcatgaaagtagcaaaaaggtagaaaagaataacccatgtttgttttatttttcaagaacacacaagaataattacctactatttcttcccttccccttccctttcccccagtaaaaccaaaagcacaatggactagtaagccaacgttctaaatgttcaaaggtggaattacatcttggtgtccgggtgtattttgcattataatgcagccttgatgataacatttctcaggaaagcctgtgcagctgtctcagcatcagttggcagcgtgtggggaaaatattgctcggaatggacttctgggagcaattttctttgatactgttctctgaagtatcaaaattggttcttcatctttgacaaaggaaaatgtgcactctcaagccttacgaagctgaaccacatttgaggtgacaaatatattcctttgggaagaaagtattgtacagtggaaagaacaaagcctttgcagccagagagatctgggtctcagtcttgtatctaccatttagctttgagccctttggcaaattaacttttctaagcttttgtttcatcatccacatgatgggttgctgcaataataacataagatgacatatgttaaatgttgaattggaactccatatatcatgtgattgctaataaatctacttggcaggtggagcggaaaggaaggagttgaatcctatgtggtctggggagagatagggattgggggaacccaaatttgggtgataaagtttatgtctccaattgaaacccaagaaaaacagaactgttcagattttcctcgatgttctagctcagtgactatatagccctcattttcagacagcaaggaaaggtcggtagcatatacggcacaattgggaggcagatgggccaggctacatgttgctgaactgactcatgaactggcagtaagtttacttgtacatttcccttttctcagtttcacccacagaaatgtttcaagtgaaggccattgtgccaggacagtatataacgcacaagatttatagcatctaggaccctaaatgaccctgcacccccctcccacctctcccttattctcttctcttctcctcctctctctttagaaatcattatcgccagagtacagctgttgcaggcggagcatctgggaagtgctactataccctcacctttgctgtcaccttcccacacagtgaggatgtctgctacctggcctaccactatccctatacctacacagccctcatggtaacttcctctttatagcatcactccagcaggactgaaggggctctctgaggttttcctgggaacattttggagaccctgacatcctgatggggtgcagaggggaatgtaggggaactacagccttcctaaaggagccaggttttgttgttactgacttggtgctttctaattgtcccatctccttccctggacagagcacaaggctgagccttgatcagtgacattccaaaggcccaagtggtctgcaagttggggcaggacatgggggcatttcttaagagactctgtctttaaaaagtcaagttaagtatgaagtaggttggagttgtatggggagcaacaccatacaagtaagctgagatgcaaatctgaagaaaattcagtcattcagaggaatggagaaagcaggaaggtagatcttgggaaacttctgagtctgtgtgcaagtagccacgccagcatctccagtggttccaatgaccatgagctggaggtggctagaaggatccagggtggaagagaaaagtgtaagaataaaacactagatcattgcaacagacagccacaatctttttatgagggagagtagaagaagtcagtgcagactcacagttagcattcctgtgtaccataaggccctgcaaaaagttcacaagacaattgtgagaaaatggactgcttaaaccatgcagctttctgtcatttgaaaaagctggcaaactaacccttactgctaccatttcgtggatatcctgaggataaatgaactccagtatcttctataaagcactttcatcctctatgttaatgtaaaatgttattagcatatttataatcatatgtgtgtatatgggtatatgtatcacttagcctgaaggatgagcattttcattttaaggctgtgataaggacttggaaaagataataaccaagaacatcttttccttcaaaaggaatgtgcaggtataaatgtgaatttttcgcatagagaaggcatatcttgaaccacttggctcactgcttcatgaaagtgcatctgtcctcttctccatatgttgtcttgcctaaagagagatttttactgttttccagattgcaaaaaatacacaactagtattatttgtgtatcacacttagagagctcaagaagttaatccaagtaatgtgcgttgcaagctaggctgtaacaagccacatttgttataaaacatgttttgttgcctttagggacacagaacaggcaacattcatctcccttcaacagctgtttttatggtcttgcctgtgaaacactgcacatgaaaagtctactgtgggctgggcacagtggctcactcctgtaatcccagcactttgggaggccaagatgagaggattgcttgagcccagagttcgagaccagcctgggcagcatggtgaaaccaccatctctacaaaaaatacaaaaattagccaggcctggtggcatgcacccatagacccagctacttgggaggctgagttggaggatcacttgggctcaggaggttgaggctgcagtgagccaggatcacacaactgcattccatcgtgggcaaccaagggagaccctatctaaaaaacaaaaccaaaagcagaaaccagaaaagaaaaaaaaagtctgctagggatggggattccttttaaaatacgtgttatgtgtttgcctttcccattgggtaagtgatcatggatctaggacactgttctttttgcttgttagaatatcttggactctgataaggttcctggtggccattcatataaaacattagaatgcaaaggggttgggtgaagttgtctaattcacccttaacgtttatagatgcaagaactgagaccggaagtcccacatttagctagcagccatgcaggaacagaacatcagcccttgaggtgtattcctgtggtctttctactcccctgtagaaaagtgtagaagaaattcagaatttctgccctggggtcagattagtgtcattgcttgccattacattcacaagctgctaaaacatgcagtcgttttatgagtccatgtagtcatcattgtgtgatgatacagacatctctaatgtttgaattcaaaccaccagcccacagtttttatctttaatgctgagtgccgtggatgtggttcagctgagggataatatctctttccaaacatggtctaattcttaccccaagatgctccaatggattcttgctaggtgcctacacactgattcaaattgtgtacccctttcaacctggccttgacttgatggtacctagttgtttaccttgtgcctctgggcctgcttaccttctgggcacagtttcagataagaatacagggtctaaaatttgcaattgataaataactctaagaaccactgggtggggggtcaatgaggagaagatttcatgttaaagggaaacaaaacacacaaaaaagaggacccccctctctccaccagtcactaagtttcactgagagggaaagagaggccttgttaattgatgcttattggcttgttactgttaacaatattaataactattactgttactattaattacaataagttataactacttacgactttttattgttacttttgagcctactgactgtgaatgtcttcctccagggaagtttgtggagagttaatgagaaagagggataacttatttctcctaaatgaacaaaacagggttagaaagacaatttgttacttaaaagtgacaaatgtgtattctcaattttaggttttacatttccaataactcatggtctttgtcctctctaggtttaagacaataattgactctgtgacttctcttaaaaaaaacttcctcccatcatggacaaaatgagtacattctgtaatgctaaccagtcatttttgtttttggacatgtcctgaggagaaacggtttttcttccaacagatcagtgataaattaaatgcgaatgataccccaaggggagaattaactgtatgttacttgggggttatgctgaggggtagaaaatacgtttccatgtggaattcataatttgcgagtctcctataatatggattacatttagtaattacagacatttttatagcataggacttgtatgttgaatgtttttcaacgtgactacaattttgaaactctcaaaatttttttattctcttataataaggaaattagtatttggttctttcaaatggatatcttccagatgcttgccagcaagtctgttggataatcgttcgttttatagcattcaaatatagctaaaagaaagaaatatactattgtaattctgaagcaaacaaaaaagctctattttaatcagccgtatcaagttatcagtaattgtaatgattgttaaagtgttagcaataatcgttacagtattagaattatgttataaatagcccctaggtagccagtagtattggttgaaaatggggccccaagagagtttctgatgaatattttaggaggtaaaaaattgggatctcactgagaacttataactgtatgaaatgacaagagacaacaaaagcggtcattagcagagtccatgtattgggggagcttaaggatcttaaaggatagagcagaatttttaccagacacatatacccactgtgaaagatgtgaatactgttatctccagagacaggggtgggatggggaggtggggggaggtggaagaaagagagggaagaaagaagaagaaagaaagaaagaaaagaaaaggaattagaatgccacatgcacaatattttataaaagactcagaataaatgaagagtttaagaagtgtccagtgggaaatgttgacttacatgtggcatatcgaagatgcaatgagcaggccataaatcagcactgtcaagtaatcagtagacagagatccatccttgtataggccaaacaaatgacagaccccaataaaggttcttgatgttgaagaggcgaacatggaaagccattctgaagaagccaatatgtgcatgaatggtacagtctttgacaacaaggacatctgaattccagggtcttgggcacaaagaaagaaagctttgaggtcagacaggcctagattttagtctaggtgttgtgtttccttgctgtgtatccacaggcaagctatttaacttctcttagcctcggttttctcatctgtaaaattggaaacaaaaaagcagtgactacataggctatttcgaagattaaataattgctaattggaaagttttagcaaagtgtctacatcttgtaagcaatactagatggtaaccattaaagcatttattgttttttatgatgatgtgcgattattttctctgttggactgattggaagatacccgttccataattcatactaaaattaaaataaaaaaaaaaaaacaaatggaagacccctcctcaaaaattacaaaggctactgatggttttcttggggtaattgattatgattatttttttcttactcttttttccaaatcatcataatatagctttgcttatttttaatggacaaggaatattaaaccatcctttctttataattgacaaatctgtgagtagatatctagagactaatcatttctcacatttttaaagttaagtccctttaacttggggagcataatattggcagactgggacagtttgaggaagctcatcagaacatgcctgtagcatattcttgtaccttttatttagcttaagggtgttatttgttcttctcttgtgataagaagtctttgattctctgatgagtgtatttaagtgacaactgagatctaggcagtagacaaataaagtaggccatctccttaggagtgggctttcttctaaattaggggaacagagagtgcagcagtttagggggtaacaatagaaaatgaatggtttttgagtgcatagtgcttctcactttatcagtagccatcagcaggttaccctgctgaggtcaaggaagtcttttatcaaagttttaagggagtagttgataaaggaaagggagactgaggactcctgtggagagacacaggatgaggctgcaggctaaggttatcagcttgatattgttcacagacaggattttcttttaagaagtcagtctctctgggggtttctacaattgccttaaactcattcacatttttataaagaaacccacccctgtggcttccacagggctgtaattacagtcagttggcacatgcattcagaggtcctacttttctcatcaatgatccccacaatatccaattaggcataacttttctggaccagagatgggagatcatttttaggagaacaggacaaaaccatttttgcaaaaggaaatccaacagaaatttatacttggtttacttctagcaatcttttatatgactgaagtcaaaataatcccctaaaagtagaagtgttaaatacttgctggacctgatggcaggtccagcaggagggagatttcattgaggggtgcagggagatggatccatgaaaaattgcagtttacagaaaatgagtaatatggtttggctgtgtccccacccaaatctcatcttgaattttaggtcccataattcttacgtgtcgtgggaattaattgagtcacgggggcaggtctttcccatgctgttctcatgatagtgaataagtctcatgagatctgatcattttataaagaggaattcccttgcacatgccctcttgcctgccaccatgtaagacgtgcctttgctgttctttcaccttctgccgtgattgcgaggcctctccagccacgtggaactgtgagtcgattaaacctctttcctttacacatgacccagtctcgggtatgtctttattagcagcatgagaatggactaatacagtgagcttaagctaagagaatattaggcatttgttgatttgtaatattattgtggaaaatgtaataataataataacaaattaaaagataacccatgagagaagaaaactttcaggctttgcctcgtccaacatttgctgcttgggagcctgtccagccaacactattttgaaggacagtgctcatgtgccctatgatactttttgactttttgtctctcatagctaatactgcttggtggcttctatagaccaaccttctgcctaacctgcttccgcatatctgatttataaaatctagattttatttttttttaaagtttgatatcaggcaccaaagggctatggcttaattgtaatatcacagaatgacgactactgctttttgtttttcatttatttgttcccccttctctcttttttctttttctttttttttacagattgtgtttattatttatttttaatttatttataaaagtttcatttttaattgacaaataatacttgcttatatttatagggtacaatggggtgtgttgataaatgaatatgttgcagatcgatcaaaccagaccaataaacgtatctatcacctcacatatttatcatttctttgtggtgagaacacttaaaattactcttttagggattttggaataattctgtgtattattataagctatgattactatactatgcaatagatgaccagacgttattcctcttgtctaattgaaattttgtaccctttctccaacatctctccattcctcccccttgttcccgctcctccaggccctggtcaccaccattctactctctgtttctatgagtttgacttttttatatttcatgtataagtgagatcaggtggttatttgtctctctgcgcccagcatttcacttggcatatgtccttcagggtcatccatgttgttgcaaatgacagaatttcctgctttttaagactgaatagtaatccattgtgtatgtatgtatatatatatgtgtgtgtgtatatatatgtgtgtgtgtgtttgtgtgtgtatatatatatataaaactccatcaatgcgcactgtggtcgtttccatatcttggctcctgtgaataatgctgcactgaacataggggtgtatacagatatctctttgatgtactgatttcagttcctttggatatatacccagaagtgagatggctggattgtatggtaattctatttttaattttttgaggaaacttcatactgttttccaaaatagctgcactaatttacattcccaccaatggtgttcagggttccagatcctcaccagcacttgctatcattcatctttttgataataaccaatctaacaagtgtgaagtggtatctcattgtggttttattttgcatgtctctgatgattagagatgttgaacatatttttttatgtatctgttggccatttgtatgtcttctgttcagaaatgcctattcaggccatttgcccatttttataaggttgtttgttttcttgttactgtgtagttggtgttccttgtatattttagatattagccccttatctgatgtatgatttgcaaatattttctcccaatttgtgggttgtctctttgctctgtgaattgtttcctttgctatgcagatgccttttagtttggtggaatcctattgtctacttttgctttgtttgtctgtgctcttggggtcatagttaagaaatcgcttcccagactaatgtcatgaaggtttttccttatgttttcatctcatagctttacagtttcaggttttatgcttaggtctttaatccattttgagttgattcttatataagggatcaattctcattcttccacatgtggttattcagttttcccaacaccatttattgaagaaactgtcctttccccattgcatgtttttggcacctctgtcaaaaatcaattgactataggtgtctgagtttatgtttgggctttagttgagaaagcttcaccactggcaaggacccatgtggtcataataaaatgtgaaacaaacagatttaataagaaagagagagagagagtgagctcatagaaataattcagcaagacagtgtttcccaaaacatattcaatagcatttcagtctcttgagaggtttagagaagaaaagtttaatggtcatctaaatttatgaagcactggtgctagtttttcttctaacagttcacaatgcatattgaaatattaaagaatctgaagaatcctgcatccacagaaatattttcattttctttaactcaacattttctaagcactttggctatgaatttcctgccttctccacctccttgttcacaccacagcacttacacactacgggatatattttgggaaatgctgcaaccaagtttccctttctggctttagagccttggaatcttgatagtaattgtgaggcaggctacatttagtctagattttgataataaagaatactgagagcagctgtcactcaaatgtttataaaaatcttaaaaataatttgtttatgatcacagagactataatctgaatccagcactatccataccttcttaactaaggagctggaattttccttttccaggatgacttagaaacgtgactgatattctgatggagacatttccattcttcttctgtgccatctctcgtgggatacccagatgtctacttcttatatcagggctttagttaataatttaatattgatttttgtaacctatgaatttttttccagtaagcttcttttaagaggctattttctattctctagtggttattttatttttgctgtttcgaaaaccatttttatttaagtctaatttcatttaattgtcagaaaatgtgatttgtataatttctgcttttttgggggaataatctaatgagtttttaatagctctatgtatgatcaattattgctacagttccatgaatatttgagaaaaaattaaaaaatattctctggaaagacaaagtttgacatgtgtctacaaaaacaatattgttcaaatactttatattattatttttatgccattgatttattcaagaccgaggtgctgtcttaaaatctcccactccgagaagaattttttctctttctgctgttttttgtgttatatatttgaatcccatattatttgattcttaagatttatgagttttatatgttcattgtgaattgtgccctttatcaaaataagatcttaaaatcccatttaatgcacttgatcttgaatatggcttcattgtatattactattgccatgcttgctttaatttatgtttgcttatgcttttagtttcaatatttctcctttaaaatgtttgaacagaggcaaacaaaataaagagataatttaagagcatttctcatacacattttttttcctttctctcctttaaaagtgcctcttatatacaacatgctgtgggattttaaaaagtaatccaaatttttgtcattattaaggctgactagcctgtttatacttaaacagtttttactgttacttgtcattttggtttcatgctattttccatgcctcaccgctgttgtctctttttctttttttcttatgcaatgtggaccatcatttctttcattttttcatcctcagggtttataactttactagtgctttctttttactacttaaagataatatatttgaacttatacttctccattaacagctaacatttattgtttcctacataacagatgctcttcacatacattatacaactaaattatagcaaccactgcatgagataggtaatgatgtttttatgtgccttttaaagatgagaaaactgagtcataaagaggttaaataaaaaatttacatcagttttttcagaatccacgcaaccagaatgtaaacccagatttcctccattccttggctcatggtacctccctccacgttcaaagccaaaaattgcatgcctcttacctccttttccattacatcccatctcctcctttggctctgacttcttatctccttctttcacttataaggacctttgtcattaccctgcacccaacctgatgatccaggatagtctcctcatctcaaatttcctaatcacatcttcaaagttcctttactgtgtaaaataacatcttcacaggttgcagggattagaatatgggcatctttggagggccattattctgcctatcacaccaacataagcaataaactcaactctgttttagagacccattgttctagtgatattctagagagtttgcatttatttggcacaatactaagtactgcctttcagttttcaagaattaaataatattactatatcgatgtaagttgaaaacattaacattttgttccacctttttcctcccttgtacatctctttttaagttcattttagagctaggtgatgacatcaaaatttgataatgtgtactgtctccctaaagaattattttttaatgtttatattaatatagtaaccatatttttagatagtcatttagatgtaagcttgtttaactgggttttattttagtctttttatattgcttttctgtttgatttgggggcagctgaagtgtgtcttcaagtccttcttttctttctttttttttttttttttctatttttaagacagggtctcgctctgtcacccaggatggagtgcagtgacttgatctaggctcactgcagccttgacctcccaggctcaagtgatcctcccacctcagcctcccacgtagctgggaccacaggtgtgcaccaccatgcccagcaatttttatgtatttttagtagagatggggtcttgccatgtagcccaggctggtcttgaactcctgagcttaagcaaaccacctgcttcggcctcccagagtgctgggattacaggtgtgaaccactgcacctgggccaagtccttattttcttattattttttatttattttttttattttattattattatactttaagttttagggtacacgtgcacagtgtgcaggttagttacatatgtatacatgtgccatgctggtgtgctgcacccattaactcgtcatttagcattaggtatatctcctaatgccatccctcccccttcccccgaccccacaacagtccctagagtgtgatgttccccttcctgtgtccatgtgttctcattgttcaattcccacctataagtgagaatatgcggtgtttggttttttgtccttgcgataatttactgagaatgatgatttccaatttcatccatatccctacaaaggacatgaactcatcattttttatggctgcatagtattccatggtgtatatgtgccacattttcttaatccagacttggaaccaacccaaatgtccaacagtgatagactggaccaagtccttattttcaataaagataaggtagtatgttgtctgagcttttgtatgtctgagcatacatgctacatttgctcatgagcaaaaacttggttggatataggtttattagattataatcccctcttctttcaagatctaagcagtactcatttcctctagcatgtagtgttgcagaagaaatatgagccaagaatgatttttttgtatacatatatgtacaatgggtttatttatgcacacacacagagacacatacacacacacaccacacagagacacatacatgtttaaaaataatcttcagtgtagcatgcaagtgtcattctatgcaacaatgagcagtgagttaagattggcaatcaaacacacaggttaggctttatccagaagtaaatttacttatccataagaaagaatacagagaaggcaacaaaacagcacacatagaaagggcttagtgagagtctggactcccaggcacagcttactttgtcctagtaactcctcactatggaattatgtggtcatgagagattaggttgagtgggacatatccatctcagcctaggaatactatcagccttgggcttccttcagatttcatgcttagctagttgtgtaggttgtgtgtgtgtgcttgtgtatgtgtagttagtcatcttgtattctcaggggtatgtggctccctcccaatctccaatgcaggtgcatctcatcaatacctgatactcgttatttgatggacaatcataacaattacatacaaagatttggttagatacatgggcctctgctggatttttatttatcttgaatctggtataaacatgcttcttataattcctttacttagtgttgtgtcaaatcctggctttctggaacatcacaagaacaacctgtttctaagacacagttgggtttattgctcatgttggcatggtaggcagaataatggacctccaaaatgtccacatcgcaatcctgtgaagatgttactttacatggtaaggggactttgaagatgtgattagagactttaagatggggagattaaccttgattatcagattgggtgcggggtaatcacaagagtccttataagtgaaagaattagataagagaatcagagccagagaaaaaaatgggactgaatggatgcagaagtcagagtgatgcaatttttggctttgaaggtggagggaggtaccatgagtgaaggaatgcaggtgacctctagaagctagaaaaggcaagggaagagatcttgtatagagcttccaaaaggaatgcagccctactgacaccttgaattttgcccagtgggacccattttagactactgaccttcagaactataagataataaatttgtgttgtcttaacctacaaaatttgtgatgattccagcagtagtaggaaactaatttacttgacaaaggagaaagaatgggacagagtcttactagtgtctcaaagggcagagggcaaagtggggatatttattgagaccttaaagcctggcttaaaggcagatattttaatgtgggggcattgattagggttgggtaaggatcaccaagtaatggtttaagattggtggacactgtaaggcaaggattttgaaaaagggtgagaagagggattcaaagaatcttggctcaaagatgggttgatgctttctattgaagagttgatgggatattcctgaaatgaacaatatatttatttgtaatttctgtcttcccagagcagtaaggttatgctgatgaaggttggggaataatagtcatgttaatgtagacagtaagctatgtgtgggtaaatgattttggttctcagttttaaggagaatatgactcaaggtcaaattttcaggtgcccctgaggctagagaaaggccatagaattatctggtaatcttttcttttcttggcactttttctttttccttgcaattcaactatttcagtagagtataaataggttttagtctattcctattcagatgtcgggatttgtacttactttaggacattctttttcccttgtatgttagttgtctattgctgcagtaacaaactacaaaaaatgtagtggcttcaacaggaacaggtactttttttaaaaaaaattgtacagctttttaggttagaagtttgacatgaatctcactgggcgaagaccagggttttggggttgtgtttcttctggaggctctgtggggagagtgtgtttcctttccttttccagcttctagaggccacctgcattccttggctggtgatgcctttctccatcttcaaagccagcaagggaagactgaggtcttatggggccagcagttgttctctgcagccaggaaagggcctctgcttttaatcatgttgtgattagattggccacaactggacagtgcaggacgacctccccatttcaagtagaccttaatcttaaacatgtctgcaaagtccctttcaccatgtgaggtatcctaccaaaggttctgaaggtgagaacgtgaacatctttgggggccactattcttcttaccatatctgtagtaagttatttccacatgtaaatacttcctctaccttttgaagacactacttccctttccatatattttatatatttgtcaatatttttacatattcattttattaaaaaattcatgagttttttgtttcatttacccagcaggctagttatttgtcaagaaacaaggtgggcggtttctccttggccctcttaatacctccttgattgtggaaaaaactttctacattttaagctgggaggataatttttgggcagtggtgtttttgtgctacagagggggcagtgtttccctctctggttactgaaatttccactgtcaggggatgcagtgcaggtggggaaaatctcttagcctctctatgactggtgcccctgttttgattagggaaaatttcttcggaattcttaaagattgttaaccaggggcgggatgtggtggctcatggctgtaatcccagcactttgggaggccaagcagcgtggatcacctgaggtcaggagttcgagatcagcctggccaatatggcaaaaccccactctctactaaaaatacaaaaattaactgggtgtggtcgtgggtgcctgtaatcccagctactcaggaggttgaggcaggagaatcgcttgaacctgggaggtggaggttgcaatgatctgagattgcgccactgcactccagcctgcctggttgacagagtgagactttgtctcaaaaaaaaaaaaaaaaaaaaaaaaggattgttcaccaggtgtcctaatttcaatggctatttcatttttttttttaaatgagtattggggaggtatggtaggaaaaatttgttgctattagttagttgttcttttagcttagcagtccccctggattaaccacgtctattattttttcaatgtgctcacatttctccctattactttgccctgtgatactatgtgctgtagaagttttctgtctcattttccccagtgttctgggcatgttctattttcatgataaccacatttttttttaattttaaggaaggcatgcttagatttgtctcttttctttttaaattgtttgctaatttttatttgtacaaatttatgggtacgcgtgaagttttcttacatgcatagattgagcaaaggtcaagccagcacttttagggtatccatcacccaaatgacgtacattgtagccattaacacatttctcatgatcctcccccaccccatcccctgacccttccgagtctccattttctgtgatttcctcgtatgtcacagcgataggaagagggctttatgcccctgccctcctccctcttgctttcagtgcaacttgaaaacagatcttctgttatgccaaaacatgcaggaatgatgcttcctgctcagtctcactgagtttctcctacacagtagaaatagcccccttttaatcactcaaggcccaatacataaaggacagattagattaacaacaatacttctaaactatatgtaagccgttgttgttttctattattgttgttataaaaaatgttgataatatacatgcctgctttatttctgctccagactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgtgagtaaaatgggatcctcttcgtagaagatttgactaagggtgtcctttatagtcttggaagcattctgtctcttttagatcaaaagctccataaagggttggagactgtctgtctttgtagaaatacacccccagcttttcttggtgtgacacaaaggttaaacattaatgttgctttgttgttaaagggagagaaaatgaaatgaattcaaactgtccggcagatgaaatgacagtttgctaatgatggtcacttcctctcttaaaacagaaccaggaccctgaatcatattttccaacttctaatccagggacttttctcactgtgctcactgctgttatgtgactctcagtcagtcaaggtttggaaagaaagaaagttgagtttttaagccctggctaaagaatccccttgataacctgaataccatttgtgtctgaagggctgaagatgtggacaggctctagctaagaactttgaaacaaagtcaaagccaaactcatgcacacacacgcagacacacacaaatatacgcatatggacatatagacaaacacatagacacatgtagacacaaacatatacacagacgtgtagacacaaacatatacgcctagacgtgtatacatgtgtagacacaaacatatacacagatgtgtatacacgtatacagacacgtacacacaaacatctttaaatgttgggcttctgtgcctaagtgcatatgtgcgactgacctgttgacctgttacgaactagcttttgaaaatggcttctgacatcatttcagaccttaggtaggcaaaaaaaaaaaaaacaaaaaaacaaaaaaaaaacacccaaagaatgaggaatgttttgtgatacagagaagttttggaaattaaagaagaagctggatgcccagcttaatttatccccagaagatactgccttccgtaatgaagatacagccttccctggtgaagatacagccttctctgaggaagatacagccttccctgatgaagacatagccttccctggtaaagatacacccttctctgaggaagctacagccttctctgaggaagatacagccttccctgatgaagacacagccttccctgaggaagatacagccttccctgatgaagtgctagcctcattcaggtgactctttggtagatcggaattatattttctcacaccccatcagcatctgacaatggatgcttaacaacctggcaaatcaacaaccgattaacccatctggattaatgaggccctaaaatgctttaatgaataataagggattttccaaaaattctcttctgtgttttatgcatttaagagcaatttctgtaacagtcacagagtaccccccgtcagcagatgagcagtgcttgggagctggagacagcaatcctcccagggtaactttcattgaacaattatttatttaagaaagtggatgtgtgtaagtctgagcttctttttctaaaaaagagttgagcagaactctgatgtatcattatgacatagaagtgcctccgtttttgcattttgtgctgacattggtgtttttgttgctgttataaatgtggagagtattcttactttaagaagaggacttgaaacatgcaaaggcccttaaataatctggcactccaacaaatagttctgttaaaaaaagagagagaaagagaaaaaatatctcttagtacacccttatatgaatcaaaagaggctggtttctgcttgctctgtaagatgggttatagtaagtgtacactcttatgatcataacagcttttttttcttttaaacacatgctaacatatccgatgttcatctcaagaagtatcagataaatgctatgcattttctttttgtcacttgcaaatgacaatcattgagctagatcctgaggaaaccaggctttgacctagatgaaagggctagttagggccatcttcataggtgtgtcacctatacatttgcagagctctcctgcttagaagggccatgcactctgcttaatgcttttctgctactatctttataaaattctttacaaagttttaaacaaggggccttgccttttcatttttctctgggccctgcaaattacatagctggtcctggatgtgatttaaggtcataaaggtagaaagtggcaaaggccagtgcctttctgatactactcttctctgtttccaaattatgcatgaagagctttaaggtttaacctatttttcccactccctgaaaatactatttgtatggattatgtagctgattggtatctttcatcatggggattaatttcaggaccccttattttacagatggggtaagtggagctcagaaaggttaaatactatgatcagtagaggtgacagattttcaacattgttattctgattccagactccacacacacaacaaacgtgctgactcctttgttataacacatgttcagcatcaacattttggcttcactcttggagccataacttcctctcttcctcattctgtcctcaaattattagatactagctgagttgttaaagcatttatgctaaattgaccacaaataagtgtattactctcttcttgctcacaacgaattttattttcctttcctaacccaatggaagcattttcatggtgaatgcttcagatactgtggcaggaagggagaaagaaaattctttctgcctgaaggcctttcttcatacccagcagatcccagcacagagctgagattgcatgacctaagccacgtgctggggcacagtttcagcagggctacataataaaaatgtatacagggtacgtgtctgtgtataatatatatatatatatatatatatatatatatatggtaactatatatatatggtagctatatatatataggtaactatatatatggtaactatatatatatgaatatattcttatatatatatgaatatattcttatatatatatgaatatataaacacatgccgttgctgtgtttctaaaagaagaaaaaaaacccagcccagtataaacactgcctacccttcaaagtgcaaataaccatgcctgtaaatcagaaatggaactacttattttcctttgaattataaaatgtgatgtattgattcaggagaaaacagcaaatgagcctgcagctcaagattctcctgcctccaggcctcccttcaggtgagattaaattgttttacctgcttcctgcctctcagggactagggtagcttcagtgtgggattgcatttagctgcaatttagctagtttctggttcagtagctgtcactcacccctcataaggaggcatgagtggaaataaaggttttctctccactgtgtgggattattacttgagtcttactttagaattccatgaaataagaccacggctatggaatgctgggggaactcccctctcaaggctggttcccctgatgatctggtctaaagtcctggacctgaagattactgaggacaacttaatgattacttttagttcctcccagggtctgagctccagagagtcttccaaaagtgtttattttgtttgatttatttttcaaaagcattttctttttaaagttattttcctgaaaacattgagccttactttcttgataacttattttcagttgagtcgtcaccagatttgccagctgtgtactttatcactatttggagaactgaggacagtccctttttgaaatgctcccaataaagaagacttactactttacaccttgatatttgagccctcaaagccaaactgtggcaggtcttcaagagcaaaatcattctctgcccttttcagtgggacagtgaacagggaagttctctgggagattgtcactgaagtcattatggaagaggggggcttaaggagaaaatgacggtagcagggaacctttacaaaaggatcaacagctcagcctggcatcagggactctgagtgatgaataggcgttgggcagttaggaagcccaggcccttcctaactagtaggatttgggatgtcaaaggaagccaggcagggcatttgggttttgcacagcagaacgggagtgaggaggaacacacagaatccaagaaaatggaacaggagctccaacaggttggagcagaagatatcccataagctgtttgggaataggcttggtaggcacgatcagtccaggaaattcttttcagtgccttctgagcctagtctccattggttaatggtagtctggcataattacatttagcctacttaaatccttcaacacattatatgtgaataggtactttgattagcataccctttgaatatgcaagcttccaggtagatttgagaagttttctatctttagtttgtatactcttccagaatgggatatgtcggtgggtggtgtggtatctcctttcttaaatttgaactgagagaagatgctgaatttaagcagaactaaaaagcaatcagaataaagagtcttggggggtcattatttatctaatcctggaaagaagaatgattctacctttgcccagactcagccatttccgaaaaaccatgcctgttttctgtttcttctcacacagatggagttgcctttgtgtggaaattcctcttagtaatgagctcttggccttcctatacttgttgtcttacctccattttgcagatggcatccatcaaacatattcccagatacccctctttaggctttggtcttactggactattacccagaaatgcacacaaccagaacacactacttagtgaaggctactatcatttttttaacttctccatttttttctccacattgctctcacaacctcgcattctaaatgaccattttagcctggagaaagttgagtcccattttagtttggagagctatatctctggaagatgcttcatttttcttagaaagtttattgccaaactggacatctctacatttagaccctataacaacattgtcttgactgtcctcatgagtgatctgagagaaggaatgaatttgtgggaattttctgagggaaaatgtcattctcctattagaaaccctcattctctaaatgaatagtcacaggctgattcactggtgagaagtcaagaaacaacaaaggtggctgggagggggtggatatgctatttttgcaatctgagacaccgccaccctgcatttattataatctaaaacagcaaagcataacctttctatgtttctggaggtgagataatctcactcccctgccacagtctcctatggctcacaactgttctttccagggggcctgaggtggggaaaagcaagaggctgcatttgcagttgttaaagaataactttctttttctttttcttaaaaatattcttacaaaagcaatgttctattcagcctgccattatgctaaaagcttttccttggaagacaatagctgttctcagaaaaaagatttacatggggtcccgagggtgtaatgagctactgcggcacctgccttgggttgggagttgtcacttgtaagtggttttaaattagaaaggagtggaaaaatacacagttacagaattccccttttggcttctttgcaaatcattttccactctctctggcctttgtctctttctaagcctcctgatcaggtgtgaagaacagagctttccgttggggagagctggaagtgacaacagtggttggtcccaggaaaacagaaactcaggcgaactgcaaaactctcactctggacatttctgtttttgtacctcccagagacatgtggggacaagtatcactatgggattactgaattttagagcttaacaatccataaagactattgagtcctgatttctcaattgctggtgagagattgggctgagggacatagggacatgagctggactatctaggttacctatctagttggtggcagaggtagttctagacctcagcctcttgtctcttggcaatcttttttttttttctggaaagtgatgcttttgacaaatagtacagctaaaaaaaaaattaactacaagagcataatgagttctctccatggaaatctttaataaaagaagtcagagaaactgaactgtgcccttttcttgtcttgggatttccatcttttcaggcaacctgggctgaagatattaggaacacatagataagtattatttagtctttgtcactgaggtactcataatctacagggtgtgtgtgtgtgtgtgtgtgtgtgtgtgtgtgtgtgtgtgtgtgtgtgtgtgatgtcaaacgggtcattataatacagaaagttttaacaggggtgaaactaagttcagcggaagcacagagaagagaggatgtatcttcatggtaaaatcaaagggggagttttacccaccatggtcacctgtataaactccacgtgcctggtggtcttgtattgacacagctttgctttcaaagaaagctcagttggcaatccaaaaactattctcatgactctttcttgagaatacatgaaaagtaaaatatataaaacgcatcaaaaccatcttaaatttgtttttcctcatttttctcactgttgttgatctgcctgcatatcaacagtgactcaccatgatcctaccctcttcagatacaaaccctcaagctgtgtgacatcgaggatggttgaatatctcctttctgctttccactttggcctagtcactttaataataagaagtcaggaatccttcctccttctaaggctggttgaagtgggtgggaaagattgtaaaaccttaaaggtagttgaatagcttggctaacaccctatcatgtaaatattttattcttatacagttttacataatatcatttggttcttataattatcttatgaattaagaaagacagtaattattacacctattttatggatgataaaaattagattcagtgccaatgccattgatttacactttgaagtcaaacttctatatgcagagaaatgggggcaatgtcttttcaagtagaaacatagcatatgcagaagcaaggagacctggatatggtgctttgaaaatctcagggtggacaggtgtggtggctcatgcctgtaatcccagcactttgggaggccgaggtgggtggatcatttgaggtcaggagttcaagaccagcctagccaacatggtgaaaccccatctctactaaaaatacaaaaaaatgagccgaatgtggtggcacgcacctgtactcccagctacttaggtggctgaggtaggagaattgcttgatcccaggaggtggaggttacagtgagctgagattacaccactgcactccagcctggatgacagagtgggaccctgtctcaaaaaaaaaaaaaaaaaaaaagtaaatagaaaatctcagggtacaggactacagaattgtggaatgagtatggggacagcagataaaatgggaaaagtaagttgggctaaatgataggtagccttctttttcatgttaaaaagtttttattgaaggcaattatgagctaataggatgttattaaaagcagagaaatgacaagatcagatttgttttggaaagttttgtggcagtaatgtagaggaaagtttggggtaaggaggatagtggtgtcatggagtccagcacagaggaactctgaagcatttacgtcttagacttactggggttcaaatattggctctgccatttgttaactttatgaccttggaaaagacgattaaacactttgtgtcatggtttccccacatataagttgtggataataatactttttcatagagcaatttgaagattgtaaagggcttagaagggtgtctcccacatagtgagtgttcaagaaatattatcagttgttggtcaactaagtgggtgatgaggtttcaaaggaagataggtctagggaaatgggagggaggggcctaaatttaagagatgtgtctcagaagtgagacatccttggtgactggctgagagtaggtatgaagggtagggagttgaaatattaatatttccactttggttggtgggtggatagttgaatgccaacaaagaatatgtgaaaaagagtaagactgttgtcgggggataagaagtttggttttggaaatatacattttcagaggcctaaaaattatttaagaactaaggctaaatataattatacagccaatatgctataaaatatactctattttagagagaaataaaacaaattttatactacctaattttctcaatcagcaaggatatcagagttaattctatacagttattacagcagaaacatgtaatatatttcatcagaatcagtcctagaacattctattctacaaatttgttcatgtgatataatgatttgcatatttcaaggtcattatttacaaaacaattacatatgactaatacctcacaacagccctgtgaggtaagaaaaaagaaagaattggatgtattatctccatgtttagatgatgaaattgagacctgagaaagacatataataagtaggaggtagagcttggatttgaaccaaatctgaattctaaaccccataatcgtaactgttgtactgactgcctctttcagctgtgcaataatgagggaaaatcctttaccttcaagatacaatcacccatatgtcagaagaattgtttacactacaagtaatatgttctaggctcctccaatggtcatttaaacactaataacccttataattttagtaaaatctaaatattactgcctctacaatactctgcattcctctcccacccgtatctaaaatgcttcatccctactaaccttctttctacttattgaacacagcaacctaaccacctccactgggtctctatatctgctgtttcctctgtgtccaacactttttctccatagctatgcatggttgatttctccttgtcatatagtattcatgctcacgtcaaggaagtcttcccggatcatgatatctaatgttgttcccctactccgaatctctttatcacatgaccttgctactttttttcttcattgcctctatgactgagctccatgaaagcacagactatatgttgtatttttttctattgtatgtctttgaactaacacagtctctgcatgaagcaggtgcacaagacatgtttattcaacaagtaagtgaaatccctgaacctgttcttgctcctagccaccatgtaggacctttaacctctcttggaaagttacctcttacccggttatttcttgggtccccaagggtagccacaaatgtgctcataaagcagctattggctatggtctccacaccacttcattctttccctgatgcttggacttctcttggtagttgtttgttttccttgcagtctcgaaaaggacttttgccattgctatgttttcagagagttactggattccatgtaaaggtaggggaatagccctctccaaaactgtgccacacatccacactacctcaagtggtatgagtctcctcacgtttctggtgaaaacagctccatcatcacaggctggatgaggatgagatgaaccccatgcctccaaggttcagatgcctttctctttcaggattcttatacccaaggaataaaaacacaaccaatgtttctctttcaggatccttgcacctaaggcagaaaaacacaaccgatttgtcttccattgttattaacacatgtcctgagggctgggtaattagcaaccttgtcagttccccaaactcaggatataagacggtgctagccaggcatgaccatgagtttgctattaaaattcccaataaaatatgtggttttcataaagcaaaacaatacaatttattgttcatggatatttacatgtgtagagaagtataaaaccatgctgaaggaaagctaccgccagattcaagatagtgattccatctgaggaaggagaaagggaaagcgaaatttaaagcagaaagggaaagcaaaatgaaatctaaatctcatctattggggagtttgtatttcttaaagaaaaagagttctaaagaaaatatgtaaaaatgttaatgattttaaacatgggtgtctcatattattttctgcctccaactatttttatatttcatgtctaaaattaaaaaactaaaaagtgtcaacatgtcatccttgtctaacaaatgcataaattagagttagaaatgtgaaaataactccatattcctcctattactactcctcagacaattactgttagtagttttaaatttatcctttaatacacagatgcatgcacacacacatgcacactcacatactgacgcatgaatacatatgtacagagccttgaaatttaggtaaaaagtacttaaattggccttcttgacaattgaagtctgtgacttcctttggaaatccaaatctctttcccattaatctgagacttgacagcctcgccagattctgtgctaccactttacactcccacaaagtgtaagagattattttcttccatggctcagtcaacaattttatctgtcttctgcatttttatacttaatagtttttaaaattttttttaatttaattttttttatttttaattttttggtgggtacatagtaggtgtatatatttacggtgcacatgaaatgttttgatacaggcacacaatgtgaaataagcacatcatggacaatgggacatccatcccctcaaacatttatcctttgagttacaaataatctagttacattatttaagttatttcaaaatatacaattaagttattattgactatagtcaccccattgggctatcaaatagtaggtcttagtcattctattttcttgtacccattaaccatctccacctccccctgtgaccctctactaccttccaagcctctggtaaccatccttctactctttatcttcatgagttcaattgattcgatttttagatcccacaattaagtgagaacatgcaatatttgtctttctgtgtctggcttatttcatgtaacataatgatctccatttctatccatgttgttgcaaatgactgaatcttattcttttttatggctgaataatactccattatgtatatgtaaccacgttttctttattcattcatgtgttgagggacacttagattgcttccagatcttagctattgtaaaaacagtgctgcaatgaacataggagtgcaaatatctctttgatatactgatttcctttcttttgagtatatatccagcagtgggcttgctggatcatatggtagctcaatttttagttttttgaggaacttccaaactgttttccatagtggttgtactaatttacattcccacaacagtgtgcaaggattcccttttctccatactctcaacagcatttgttattgcctgtcttttggataaaagccattttaactgtggtaagatgatatcgcattgtggttttgatttgcatttatctgatgatcactgatgttgagcaccttttcatgtacctgtttgccatttgtatgtcttcttttgagaaatgtctatttaaatcttttgcccattttttgatcggatcattcaattttttcctatagagttgtttaagctctttatatcttctggctattaattctttgtcagaggggagttttaaaaaatcttaactctcttgcccccctccaaaaagaactcaccattttagtgttattctaatttgtatttttgggggcgtgactcaggtggtccatattttaaaatgtttgtgattttcatttcttccttttaaattgtttatttttaaaatcatttgtctggtttgtctattatgttagatgatttgttctataaatgatttatgaggaactctttgaatattaggaatattcctctgtgttaaacatggattcattcatttagcaaagatttattgattattgatcattttactaaatatgggaacattttctccctgtcacctctttttaaatttgttagtttttttttgcttaattttcatggaatctaatatagtagtctattttttacacttgtaagcataatgtgttaggaaaaagtttccctttttacagatgatggaagtaagacctagggaataaaagtgatgtgcctggttgcatagctattaaatatggagtgagaaatcagaatttaggtcttctctcagcagcatagggtggcgtgtgcctgtagtcccaaccatttgagaggctgaggtgggagaatcacttgggcctaggagtttgagtctagtctggacagtatagtgagaccctgtcttaaaaaaaaaattaggtcttctctaatcagacaaacagttttgtttttagtatcttataaaataatttatataacatatagacctagattaaagaacaataataaaatggacatctatgtatacacaatccaatttaagaaatatgacatttacctatattttagtccccataacaatttgctcaatggctttcactcatactacctcagagtaactaccatcctgaattctgtgctaaatggtcttttgctattctttatacttttaaatcacatatttatatatctctgaccatctactattgagtttgcctgtttgggactttacataaacagaaacattatataattctatttataattgcttatcttattaaacatattttaaagattaaactatgttaacatgtttgagttggcatctgagttactcatttttcattgctctataacgaattcctatgtatgaatttaggtcagtttctcccctagaattcatgagttgaaaccctaatccccaatgtgattgtatttgaagtaaggaagtaattaaggttaaacaagatcatatgggtggggccctgatgatactagtgttcttataagaagagacacaagagagattactccctttctctctgccatgtgaggacactgagagaagatgtggccatctacaagccaggaagagagccctcttcagaacctgaccttgttggcactctgctatcagacttccagcctccaaaaccgttaaaataaatttctgttgtttaagccacccagtctataatatttcttctaggtattttatggttttaggtcttacatttatgttttaaattcactttgagttgatttttgtatatggtgtaagataagggattgatttcattcttctgcatctgtatatttagttttctcaacaacatatataagagactgtcctttccccattgtgtactcttgacacctgcatcaaagatcaattgaccacatatgcatggatttatttctggctccttattctgttccattggtctgtaagttcgtttttatgatagtaccatgtggagttggttactacagctttgtagtatattttaaaatcaggtattgtgatgtctccagctttgttctttatttttctcaagattgctttggctatttgggatctttggtggtttcatatgaattttagaattgttttatctatttctgtgaaaagtatcattggaattttgatagagattgaattgggtctgtagattgctttggatagtatggcaattttaacaatattatttcaacccatgaacatggtatacctttccatttatatgtgtcttcttcaatttatttttcaatgttttatagtttttagtgtggagctctttcacctccttggttaaatttattcctaagttttatttttatgttattgtaaatgagattttttaaatttcctttcaaatagtttgttgtcagtgtatagaaacactgctgatttttgtatgttaaatttgcattctgcaacttaccaaatttattagttgtagcagtttttgtgtgaaagtctttagagttttctacatataagattatgtcatctacaaacagaaaaatttttacttctttctttccaattaggatgccttttatttctttttcttgcctaattggtctggctaggaccactagtactatatcgaatagaagtggtgagagtaggcatccttgtcttactcctgatcttagaggaaaagctttcagctttttgtctttgagtatgtatttagctgtgggcttgtcatatttggcctttatcatgttgcagtaagtttcttctataactaatttattgagagttgtttttatcatgaaaggatattgaattttatggcattttatgcatctgttttaatgaccatatgatttttatccttcattttgttaatgttgtgtatcacaataataacatttattgttcatgttttgtaacacatttgtacatgttgaacatccttgcagcctagagataaatcccccttgatcatggtgtatgatgttttaatgtgctctcaaattttgtttgctagtattccattggcaatttttgtatctatgtttatcaaatatattggcctataattttcttttcttataatatccctgtctagcttcagtcatagagtaaagctggccttgaaaaattagcttgtaaatgttcccttgtcttcaattttttgggagagttagagaaggactggagttaattctttaaatacttggtagaatttaccagcgaagccatcagatcctgagcttttctttgttgggagttttttgattacagattcaatctccttacttgttattggtcttctgttaatattttctgtttcttcatgattcagtcttggtaggtttatgtttctaggaatttattcatttctttgggttgtctaatatgttgccacagaattgttcatagtagtcgcttatgatcctttgtatttctgtggtatcagttgtaatgcctcttgtttaaaattttatttaaacctcctctctttttctcttacttagtttggctaaaggtttgtcaattttgtttatttttttgaaaaagcaactcttaatttcattgatccaaagattcttggtgggcgtttggcatgatccacaggcaggcttcctgttggagtccttgggcaggtggctagttccagggtcagcaggtgagtgggtctgtgcctggattcactgaggggagcctaaagctgggatctgctgggggtggccctgaatcttagttctccaagggtcagcctggtgcagggggcccctggggtggacctgttcactggatctcaggggactggcttggagcctgtgttcgcaggggctgaacgagcacctctactgaggcagggttggaccatgggtccactgaggcatggagccgtgggggccagcctagagcctggggccacagaagctggcctggcaaaagcatttctatttgcctctgttagtcaactgagagtgctagcaaactgggatgaccatattctctactatggatttttgggatcacatatggatcataaattcaaacgtatgtgaggatttgcttatcattataaattcctagggaaaatttgacataaaaagctgttcctgctctcccgttctgtgaattaagagtaaagacctttggacacttagctttatgcagggatttcctactggatgccctgccgtgggtgggccccgcgcttcactcctggttccctgcgtcccttgcagccctcagaacagaagctcaaggtctccaaggctcagttgaaaccttcagggggagagacaggcttcgacgcttgcttattttccaagttgtgtttttggtttccctttgttcttggcacttacagatttattctttcagaccaattcagcaatgcatcaaaaatgacttttgaaaagaaattcaacatttttgttgtttcctttggcaggttgttcagaatagttagtctattattctgcaaaaaatggaagttcttacccccttgatctttctactttacatgctactttcttccattagaaagaaaaatgaaagtctattttttgtttgctataatggataatatgaatttgaaggtctgtttgtaatttgaaatagcatatctgctattctacgtttagaattgacattattcctgctgaaaagaatacgctttcttttatggttcttggaatttttttttccttagcagatagtaagaattttagtgaagaaatattttggagttcctgaattaagattccaaccaaaacccgggttttctccggggcttcctattttttttcttttttttgacatcacgaatatcaacagaagagtgtgatttttattttttccgcttgtaagatgactaatttacccagaggcacctcatgtgtgtttttagtcacctgtatccaacatcaacaccagaaagctcaaaaagacaagttattcgatataccacacccagctgttctgatctgtgaggcttgcttgaggtaccttcagctgcggaaggagcttgttcccttgcagctggtggaaattctctcagtcccaagatggaacttctaaattgtaacttacagggcgggtgtaattacagtaattgggacagtgaataattctcagcatagctgatcgatgttcccatgctctcaaaaatcaggatagagtgatgtagtagaacccagatatgaatcctagctattttttcacaatgaatgttcatgacctagtgggagtcttcatttctctgttagagtaagtgatgagtgattatggccacagggacatcccctcaccccaaaacaaaacttacagtcacattcaagccagattacagaatgctgagattgtattgtactaccacttctttcttcttgaaagcagggattggattcagtagaggaaaaccgatgtgaatgatgtggcaatttccaatttgttggtggtgttttcctactgccattcgcccaggcaaagttgtagaaaggaagttgtttggccagacaggagattgtcaatagcagcctctcgaggcggtagctgggagctcacttcactgattcccttcacaagagagatttggaaacacaggttatgagctgagtcactgggcaaattaactgccccaaatgtgataattaaaatgtatgtccatgagccaccttggtaatgatcaagtgatcaagttctccccttaagcaactgtgcgcattgttgcctttcctggtaacagatgatcgcattaagagcttgcatgctgcagctcagagggaattggtgttaccccagtgtcctatgtgtatcttccctgcagctgattttctgtggctcattgagcaacgagtccaggtggcagctgtggattttgacatcccagaattttacagggcaagggcattctcaacatgtagtgatgcacatcccgttaggaagtggctattcatgaaactgacagggtaaagccctaattagaaagaccagcagggctctctgtaccccaggatgcttcaacagagctgtcactgtctcccctcaggcaggatcattgggctgaaacactgagcaaaaaacattttgttcaatgttcaacaaaaataactcccatcattagcaacatgacaagtgaaaggacctgcatgtcaaaagaaaaggatttatgcgtcgttgtaaataatgagtgattctaaaaactttaagctgctggggaagcagctttcagcttctggaaggtgctgttggaaacccatagagtcaaatgggtatgcttctctggttttcagcagatggaagcttaatttgaggttttgggaacactttagtcatggtaagaagtgggggacacctgaatttgaatcatggattatctcaatattttgcaggacttatttctttgaggtcgattttcttggtctttaaaatggagggttgtaagtgactatcttctttgtttaggtatataatgtagtcttgtttattcagattctgaactctttagaaaaaaaacaaagaattcccacataccaaattgcagtctaagcacacttacgcaaacaacatttattccttatgattaaaaagaaatgtagccagagggtatggcagtttcttaagttgttatgaaaagcaagaatccttatcttaatttcttttcaatcaataacaatttctaattcacaaggaaaaggaaagcgaaatagaaactgtcttcctttgaaggaagctgtgatgtaatgatttgctgggcaacttacatagtttaattaagcactctgattaaatcaatatgtatccaacagttcagcctggcaatcagcttaatctcattaactgttgttcagaccccaataattgattaataatacattatcatttatgaattattgacttcaagttattataattgtcctgctttgttcatagcacctgctgccacatgttaattatgaaatgctcaagcactttcttggaataactttagagataaagctgatggggtttttaatgaaccaagattatctttagttcagagctggtcagaagagctaggctttttcaaccctgtattgttcattaagtgggagcaggcatttagcatttttagagctgaggctcaaataattagagacagggttggaaggcacccacacacaagttagatgatgagccctactaaatgagatgggtgatatcagaatcataaacgcctagatccttactgccacaggattctgcttattgaggctatctgaatatatattaaataggtatcattcctgctctccctcctggtgcttatagtctatctttgaggtttggatatgcccaagggtattttaggagaaggaactgacctctcctgggtataggtgggatgggtaggagctattcatggaaatggcctcccactctgagagaggcctttggccaaacaagaggagttaccacacctaaaccaggatagcctgttgcatgctacttcatttgcctagttctgtttagttattttttctggctagtaagatcttcctttagagtgccagcctggtctatgctgggggagtcaagacaggagctgggaatgaattcacattaaaaaagggcatggtgtccccatggccagcctggttttggcagcacagtgaattcttgcttgatatccaaaagaaggatgaaatttaaggagcaggaaccaactggagaaattctatggccccttcctctatggtgggtctctttgcacagacatttctgtaggacctgggcttaattttattgaagacaccctgggaggcatcattatcaccacctctggttcttagcccaagaggaacccttcactcaggaatgaattggagctcccgcttgtaacagtgactggctttcctgagacattgcttccccagtaggaagtccctttaatcctgagcacctcactcagaaaccagccgtgtaggaagtgagatttaatcttcaagctccatcttttctcgttgtgaattccataaaaagccatgttttcaagggcatgttttccaggaaataaggcattttgatagagttgtaaaacatgggcttgtcatcagacttggattggaaatctcgattttctgaattttggaaagtggcttaaactgtctaagcttcgggttccttatctgtaaatagggataatattcccaccttcctaaggttgtggtgaggattaatgaggtaaggtatgttttcctaacacagcgtaaagagagggtgcttgttaaatactcatacccataatctttcactccatcctccttgttcattgcaagctgaaatgtaattgcccattttatacaatgccattttaatacccagggtaacccgaaagcctttctaatggtgaaactcaaatggataggcaagctactgaaatgtaatgtcaagagttatagctcaggtgtaggtattggagtcactcttatctgcactcacatttgggctttctctcagagtagctaggtagacttctaaaggtattgactgttgggcaacctagttaagcctcagtttcatcatctgtaaaatgaaatacctgtagtattttcacatatgactatggtaaagcttaaaaaattcgtggggccgggcgcagtggctcacactggtaatcccagcactttggaggccaaggcaggcggatcacgaggttaggagttggagaccagcctgaccaacatggtgaaaccccgtctctactaataatacaaaaaaaaactagccgagtgaggtggtgcgcgcctgtagtcccagctacttgggaggctgaggcagaagaattacttgaacccgagaggcagaggttgcagtgagctgagatcacaccaccgcactccagcctgggtgacagagtgagactttttctcaaaaaaaaaaaaaaaaaagtatatgtaaaacacagtgctaggcacacagtagatgctcaataaaatattagtcctctaccttccttttatttcacacgggaatactatagctagcatttaactccaaagtggcactggtcaaagggaaggatatagcctttcccatctgtagtttcagaaaataccagaggggaggaaatagcaagcattacaaaacatcctgcttcagcctaaagctctcaggaaaaaaccttatctatatttagtacaacaagttagagacagctttcagcaaagactaaagcactatctcattcattttattcaaatgaatccaaatgtatctaatttttgctttggcaaatgaatttccttctatccctcacctatttctttattcctagcttgtctactaaagatagacccatgaaggatgcctaacagggtcccatgacagtagtgtaaaaggtttagaggaagttacaggggagaagtgtcctatcttaatgactgaaactctgtttccgagttgaaataaatcccaactcatcttggagtgaaaggctcttccagaggccccaaatgattccttagaactttgagctgtgcttgattcattttttcttgtattcctcctctttctctcctacacggcttatactaaagaaccacacccactcatgccgtgggtggacaggaacaagccatcaaacgcaggagtgaacggagtgggtttggaagcctgacggccctggctctcatgcctgctctacccctcggtaatttgaacatctgtctcctcctctgagaaacccagaggtcagtcattgtggaggtgaccccacttcagaggattcagcaatcagtgggtcccttgactttctgcaggccaccgaaataatgctcttcctgtctgactagattttatctgtgaggtggaggagcaaattcatggtaagggaaaaatgggtcagagggtctgaagatgacaagaccacattttccatcttaccctaactgttgtcttcctcagctgtgctgatagcactcgtctgagctctgctgtgtgaatctccagtgatttggccaagtcactgtgtgtcctcctttctgatctcagttgagcactcggtcttgatccttgacttcctgtttttccctcagagcaggagactgaatcctgccaggctgaggcagtcctgtgagaagcagtgctcttgtgtaggatgattgtggaagcttgaactgggactttcagggctatgagccgtcctgtgaacaaacagaagacttcagtttccatggccgccagtctagcattatcccctcttgccatattccttcacagcatttataaacatgcaatttggtatttcctgcctctcatctgtttccggcttcttcctctccatcctttcttccaaagggatttgcataaaggcagtctatcaatactgttcttaaaggaagtgtccacaaaacactttgaatcaacctagtttctagctcatctgtttccatagcaaccaatcatgatgtcacaaacagagggggatgacttgaggtgggaattaggtggcaagagagcagatgggcttttgtaaagaaagaaaaggaaaacaatatcctatccgcacagagatttccttggtaataaagagcaagggagagataaataaagaagcaatgagagaaaggaagaatcctttccaaacagcactggagaaattaggagtgaaaattagcaacacttgcgagcaatgtttgtttcctttcaggcagtatgaatgatgaatcggcaccactcccttggggtgatgaacaccatgcacaatgaggaaataaaactttgagaggcgaaagaatttgccagggctgtgaagcaagtcacagactagctttgggaggaggattgagtcgatattaatgatgaaatagagcagggattgacaaactttttctgtaaagggccagatagtaaatattttagactttttgtgccagaagatctctttttcaactactgagctctgactttgtcacacaaaagcagacatagacaataaataaacaaatgggtatagttgtgttccaataaagatttatttataaaataggaatgggccagatgtggcccatgaaattcttgaagtggaagactatagaatataagtttcatatttaaatggaaaggtccttgatagttgtatggacaccagatgcactcctgagacttctggaccaagtattatagtgtcatgagtaaaaagaataggtgggtactgagtccaagcttcttcatttattcaacaaacttgattgtgaatctgcttcatgaaatattctgggcattgggaatacagcagtgcatgaatgtctgtcatcaaaagttttatgtcctaattagctggacagcttgggcaaaccatttacccaaagtcagccccagctttctcttgtggggatgtaattttttaaaatcatgagtcatattacatatacaaaacaatttatgtagaacataaacataaaataaatacctatttgcccactatccatgttaacataaagtagaacattgccactagtgtgtctctcccaggtctcattatccttctcttctcttcagaatattttgttattttcttttctgtctgttttttgatttaatcatataaatatttcataaaaaaaacttaattttgcctctgatgttttaaattatttgagccataatgtagtactatcctttgacatatatcttttactcaatgtttttttttttcccattcatccacacagacgtgtgtagctattaataaagcctgggtccaaagaccactagagccagatgtgtagtcaaacaatgttagagttattaactggctgcagcaatagagaatagagaatcactgagcctttcaaaggggagttatgggagggtatttataagatttgaagggtagagttgatcatagatttttttttttttttttttttttttggcagggattggtcaggatttgtaagccagagagttgctggaattgtcaatgggtttatctttagaatgcatgaatccatgtaaaggtctgtttgtggttttctgttaggatatatggatctgaatgaagtgttattattatatggtctgtgatgtacattgtagctgagttggccatagtttatttttcttgtgagtctgggtgaattttatatatgttgattaaatgatcagttttccccgtacagtcttgctaccagcaaggacattaaaacaaacaacaaagaaacaatttaactttaccactatagtttttcttcattgctatataatattccattatatgaacagactgacatttacttatccaatctacttttgataacatccgagttgttcctgaatatttgctgttacaagggatgctgctatgatgtggttcaaagtctctcctaaccgagtatatacttagaagggaatcatagtatctaggagcaggcagatgtttaactttactagggaatactgcactggtttctgaagtcattacacagagttaacttcctgccagttgtgaatgagagttgctctacatcctggctaactttctgatttttgccagtccaatgagtatgtgatggtatctcattgtagttttaattggcatttttttgataataaataaggttgaacattttctcaaatatttctttagccctttggatttcctcttttgtgatgtttctgttcatcctctcctccctccccccacattttgctattggtttgtctttctctcacattatatatggaatccttctggccactgaggtgtaataccaattctgacgtaaatcatgtttttatagacgtgggtctgtttctgttattttagttctgatttgtgttttatttgcccatctctgcactcatatgttactagctttatgtcactttaaataaattctgatacctcgtggggaagtcttgtagtcttgtactttgttttgcctctttggtagttttttttttttttttttttttttttttttttttttgagatggactctttgtcacccaggctgaatgcaatggcacgatcttggttcactgccaccttcgcctcctgggttcaagtgattctcctgcctcagcctcccgagtagctgggattacaggcacccgccaccacatctggctaatttttgtgtttttagtagagacagggtttcaccacattggtcaggctggtctcaaactcctgacctcaggtgatccgcctgccttggcctcccaaagtgctgggattgcaggcatgagccactgcacccggcctctttggtagtattttaactattcttggcctctttcacttctaaataaattttggtatcagcttgtctacttttaaaacaaaaatataaaatgtctattgagatttttcattgagattttattgaaatgatattcctatcgggaaaaaaggacattcctatgatatctaatgctcctctccaaggttttgagaacatgttatttcaccattaagtaagattctacaattggtttcataaaattttattttttttttgtataaagagcttgctttcacatcatatttttattggataatttatatacttgtggctattacaaataatatattctttaataatttcttttaaaaatgattcctactggtatagaaaaatgtgatggatttttctatatttgttttgtattttaaaatgatatacttttaaaatttaaataatttttgcaaaactttagaattttttatgccgatatatcatttgaaactgacaagtttttttttcccctttgcttctgttatattctttattttctcttttttatgattcagaacaatgcttattatatgcggtgatagtgagtatttttgtattgtttctgatcttcaaagaaatgctcttaacgtcttactattaagtatgacatttactgaaggtgtgtgtgtgcgtgtgtgtgtgtgtgtgtgtgtattcatttatgaggttaaggatgtgtctttctattccccacttgctataagatttttaacatgaatggatgttgaattttattacatgcttcttcccacatctattataattatcagatagtttttctcctttaatctgctattgagataatcacatgaattgattttatagtgttaaactgtgcatgcagttctggaataaatccatttgtcatcatatattatcttttttatacattgcttgattaaatttgcttttactttgtttaggatttgcatatatattcaaggtggtgagaggcttgtaattttctttcttttgtgtctttgtctccttttggtatcaaggttgtgcttatcccttaaaattaagtgacataatactcttttatttttaaattctctgaagagtgtgtgtaacattaataacattagaatgagctcttccttgtatgtttgggagaatttgcctctatagttctggtgctttcttgtgagaactttttaacctgttaattaaaattcatgattgattaaataatattttctggttttcttatttatttttgaaacaagtttgacaagttgtccttattttttctgtaatgtttctatttaatctgacttttaaccttgactgtaagctgttcaagttcttccgcttgtgtaattatgtccttattttctttcttaatgttgtttattcataccttattcttttctgatataaaaatttcagagaggccgggtgcagtggcttatgcctgtaatcccagcactttgggaggctgaggcaggtggatcaccagaggtcaggggttcgagaccaggctgaccgacatggcaaaaacccgtctatattaaaaatacaaaaaaaaaaaaattagttgagcatggtggcggatgcctgtaatcccagatacttgggaggctgagtcaggagaattgcttgaacttaggaggtgaagcctgcagttagctaaaagtgcaccactgcactccagcctgggcaatgaagtgagactctgtctcaaaaaaaaaaaatagaatttattttcctttaaatgccactttatctctataccactggcttttctatgtgatattttcattttctgtcagtactaattttttttattgttactttttttaacccatgaattattcaatactttctttaaaattttcaaatatgtgaagtttttcaagtatgttctggttatctatttaatgttgattgtaaattaattttattgtaagcagagaatgttatctgcctgttacccatcctttgataattgttaaggctatctttatggcttagtgtatagctaatttttgtaactatctcgtgtgcatgaaaggaatgtgtactttccagctattgggtgcattgttctgtatagccgatttaggtgaaacatgtttgtctgtgctatttgaatcttatatatctttattaacttctttttttgactgcttaatctgtctgtttgagagaattgtgttaaatcttccactacaacaagagatttgatatttttttcttgttaacagtttttctttacctattttgagactatgatgttaggtgcgtataaatttagaattattatactgtatttttctaattaattgtaacattgatcattatgtagtgattttctttaccttaaatgccttaaagggcactttgatattaatatttatgctttaaattttgaggggaccaatacatgaaatttgaggggacctggtaaatctatttccaattagattatgtctttggaggtttatttttaatgtcggttttttcagctagtttttatttgtaatatcgcattactagtatgctttatgaatattgattgtaaggtgactatttatttggaactgcatctgggggaacactttataatgggttaagttatattcctgagagaatttcttctgctagtcacccagcagcatgctcaacacaagtccagatgaagttaaattatttacttcatgactatcaaactacattagtagtgtgcatttgtactgaaaaccagcttggggatatacatggatactttcccagagtagcactggagccaagtgcagtaatttttcttgccactccctttgcaaaagtgttttgtttctggttcacttttgtattacgtttgtggcttttttgagtaccagctttttgcagtggtctattaaattttccactgtggacaagctttgggctgtttctcctatttcctgggatctgtggagttgtcaaaccaaaactcaaaatctctaggggttggcaggaaactctcaggttcaaagatgacttcaatagtcacttattccccaaatttttggttttactttactttggagcatagcacattttctttcttaggccagcatagtgattttttttttttgtattttattgaacatttcagttggttctgtgggaaggttgaatgagggcacctcatccaccatgttgctagaagtggaagagtctatttaatgaatatttttcatatcttattcttagggtggctgtggggatcaggaaaataatatatgacaaataaagtacttggcttttccataattatgtaaataaccaaataacattaccaattgaggcaaaacatgtcagggagagtcatattttgaaaaaaaaaaatcaactaacttcattctaaggtggctgtgtaagcctcagtattgtgcattgtcatgttaaataactaaatataaatggtccatccactatcaggagaaataatcatttcattgacagattatgttaagggcaatttgactagagacaagggcattgaaagttaaataactgccagtgcaaaatcctgcttgccctttggtgctaaatgtggtttaagtggtcttagggtttaaatgtgatgctcctcatattcaggtatagacaatctaaaaagaataattcctctgactctaccttgcttgaccatctgtatactcaacactgtcagtgtgacttctgaaactatccttttaccctactaaggtcatggaccattggtgctcagttttgcacagtattttgcaaacttaatggacttaccactactgacctctcttcatggtgtctttccttttctctgtgcagtctggcatgacttgctttttggaaaggatgtaatttaccaagtattaacctgtatgttgagctgctgtatatcccagaaccccagttaatggatggtgatgtgcacagagaagactgtcaataatttctgcagtgaaatgcttcatgtgctataagaaaaaatagagtcataagcatgtctcattcagccatttatttgctaatttaaaaattactttaatttagtgtcaggcactgggctagatactaggggtagagtgatgactaagatagtcctcatccttaaagaattaatgattttcttaggaggaaatatacaaacaaatagaatgtgtaagtgttgtaagcactatgatagaagcaaattagagatgaagtataaagaagggagcttaaaactctacccgggaatgaatggaggaagtcagataagacttaaaagagcaaatgatgccagcactaagggatggaagctgtaggggtaggtgtttcccattatggtggagtagacaaagggccttctctaggcttaggaatcatagtgagtgaaggtccactgatgtgaggcagctgtgaacatctcatagcctgcattcattcattagtttatacggcattcattcattagtttatatggcattcattcaaccaatttgtattggcatctactaggtaccagggactaaaatatttatagagagagtttctggttttttgacactttcacactaatgggagacagtcgataaactgtccagttaacaattaagtgagtattcacataatgtgatagtagccataacaaaaaaagtgggtggtagtaataaagaataaggtagagtcgtagtggtaaatcatttagaacaggatggcctctttgaaaagacatttaagccaataccccaaccacaagagtttgccatttgagaaggtgagtgaagtggggccgagtttggggaagagggttagaggaagtgagccaatgtctccctagctcactagcatgtgaggagaccatgtagcaggaatgagtttggtgtgtttcaggatcggaaaggaggtgagggtgactggacaagggagacagtcaaagtaagtgacattggagaggtagacaggggacagatcttggagtgcattatagaccaggctaaggaggagttttgtttcatcctatagtcagtggagaatgtttaaagggttttgggttttagaaatgtgtctcttccatcagtaggcaggataggatggaggcctagaagactagagagagaggcaaggaaaacacggagtgatttttgtaatagtgtggacaaaaaataatgagtataattgggaattctaggaagaaatgtatgaaaaatatttgggcaagaatagaggaagaatggcagataacatccacgggggatgagtagatgatgctgtcattttccaaatctctaaattaagcaggaggaactagttgtagtgggaaggaaagtttcttaaatgggtaacttttgaggttttaagagcatgagaaaagagaacagcctggagttggggaatgcagttctatttggagcttatggagcaatcaggacttgaattagagatgaatgcaggtttggcagggcctctccttttctgtaacttgctaaaatacacgatagggaatcaggtttcacacatggggagtcttcgcctctgctgccagcctggcattgttatatcaccgagtgggccagctccacagcccaatcaatatctgccggcacagccatcttccatccccctagcaaggtgagcatcgaacagttaatctccctttctccagttcttagtaactcctggtttgttttcaccagacaaggcattggactatactggaaatataggttgctatttttccaacgggtcacatagatctcagagtggtacagtctgtgcacgttgggggtggtgggaaggggcacatgataacttcttaattttttcaattttctctcagacctcctacactcaagccctcatatccagtagctgctctcttcttcagaaaattccaagccttcctacatgagcaggaagttctgttcccttatcccctcctgtatcttccagatatgatcatgtaagtctttaatagacaataaataacttttttaaaggttcaaatgagaagagtgcagctctggtcccatttgtgaaggcagatcgatgctccaattctcattcattctctccatcaacaagtagttgattttttcactgttaggaagccagcacactttattacagtgagcttttttttttcattttgttcaggacagcacagttcagtctcatagacataatgtataccctttcagtctagaagatattttcctgcctccttatgaaacaagaaatgcagacttatcagtctacactagccatgagtgtctctctcttagccatctggtgtgggggaaaaacagttccattacattctttttttacttattatatacttctaaatataagtatacataggagaagggtatagagaatgattttcagtttattatacaatgtaaataaaattatcaaatattataacaaggccaaccaaggtgaggatgcagaaaaagaagtgattcattcctttggctagagaagtttggctggtgggaaacaagaaaatgtgtatagcttttcttttcttttcttttctttttaaggatacttgattgttaagggaaagagaccatttgagcaataattagagtattcaggattgagggaggtatatgttgcttgttgttgttaattttttacttgtttgttttgtttacagacaacagcatttgagcaaccttcttaaatatctgtctggagcagaagccattcttgagatagaaaagatcagaagtgcagccaagactggtaacaactgatgaagtatctgaaagaagctagaagggggtcagaatagattagtcatgaacttctaaccatgagcaggaggtagaatgatgttatcccccatatcctcgagtttttttctttttcttttttttttttttaattttgcacagagcattatgaggtcatctgctgatgggaaatagagtaggagaaggatttgaggaaaatagtaaaggaggaacagtcattaaagggaatggaaggaaaaactgaccagtgatagagcaaagagggacagaggtaaaggatcagtggtaaggaagactgtggatttctgtggcttcaacctatgtggatgggtacttttccccagcagtgatcaataggtctgatggaacagagatagtcaatgtgcggactgacccaatgtggagggtgtgcatgacaagggagtggcaaaattggggaataaaagaggcttagggtcataaattctttgttttatggagttagagccccagctaagttcttatctgataaattggtggcattccaaacactaggtaatgattttgttcttgacacatgttagctagatatgttgtcctttacttaggatgctgaaggttacaacatctctgactcattctctgacagtaaaatgtattctttggatgtagaaattttggtctgaatgtaaatgtttccagaaattagtttagttcagcttatttattttaagaagcgatgaaagccacctaagagacaataaatcttaggcatatgtgcccagcagaagtgtttgtatatgcagtgtttgtttatgttttcattgaggtgtcagctgctttttctatacacgaaccattgtgagcatatggcattttgaggtgagtcataggaaattcagctgagtttgttaattgcccaaagagacaggtataaaactcagaaaggaatcagaatgtatttacaaatgaaccttaggcaggtgtgacttgcctaattacttgctgatggaaaaagcacagctattctaatttatttacatcccactctaatgatatgaggaggctcagcaattgccagatggggtgtgtcggggtacgtcctcctgagttgctccaggcagtgtgttttaaaggaaagaagaagaatatggtttaggatcctggcttcatagttatgtggaccccatacctatatgagcaagctttgtttttaagcctctgttttcctctttcttaaaaatgaagctcataatacataattttctgttattctgaaaacaagatgagtcaacaaatacttaaagcagagagcttagttcctgttcctatggatatttgtttttctcatttcctacctgcttcccccaactataaaacttccagctcctaaacatgagagatcaagttaatgcttattgtgattcttctcccacaacaagagcaaaaactacaggatcaaaataacctaacttaacaattataaataaattgagacaaagtgaacaagtgagagaaatggagagagaacgatacagaaagtatggtaaaaagtatttgaaagattttagatgaaattactaagacatcccttgaactatttttgcaactttttatttcaaataaaacttaaaaaaaatacaatttataaagaaaacggtttttaattttttttccaagatggcagattagaggcttgtagcatgcctcagccacttggaaatagaatgatagtgcacaaagataaactctgtgagccttaactcaagaggaaaaacaggaatccaccagaatcatgaaggacaccccaaatcccgaggaggagaatgtgggtaaacagcccctgtgacagtgtctatctcataaaatttgagtgaagccccagtacatgagagagacagacagcctccctctgtgactcacctttccactagtgatccaagcaactgaggctgagagagagcattttgtttctcccaagccctagagctaacttggaatgaggcttgaagacactatgagggaaagacactgggaaacgctgcaggcattttcccagattcaggaccaaggacaggacaccgtttttaatttgggctcatataaagtcagtcattctttgacaatttgcatagctgtgcaagcattttagtcttgggccagagattagagcacctgctctggaggggttagggacatccatagccagaactgtagacagtgcttcagcagtaggtgctagaattgtgctcttccccattgcaggcctggggtggaaggagagctgctacagctgtggtttctcctaggtgacgagacttgcagccagggccatcttggcagactggaaccagtctgcatgtatcattgctgggtgcctaccccagcctgttcccctgagttcgtggtccagcagatccctctccacttcactcccaggcagaaatccaggcattcagggcacccacttgcctggaccagcagcctgagccaccccaccctcatggacatagatgatagtgcagtggggccctctctgccccatgtccaggtagatctccaagtatttggagcacttcctcaccaggatcagaagcctgagctgtctcacccttcctgtgcatagattgtggtgcagaggggccctctctgttccacatgtagacaaatctccaggtatttggagcacccgctcacctgagtcacctcacccttcctgtgcaaagatcctagtgtagcaaagccctctccacttcatgcccaggcagatctccaggtatttggagtgcctgctccctggtcaagcagcctgagccgcctcactattcctggacatagatcatggtgcagtggggtcctctgcattccaagccaagacagatctccaggcacccaaagcacctcattacacagattggcagcctgagctgccaaactctttctgtgaagagatttgggtaaatgcgggccctctatgcttcatgcccaggcagatctctaggcattcagagcacctgtttgcctggtttagcagcctgagttgccccacttttcctgtgcagagatccaagtggagaggagccttctttgctccatgcccaggcagatctccaggcatccagagcatccactctcctggattaggaatttaggcttccccctacatcactgtgcagaggacttggagcctaggaggttttccagattcagacttaggcacacatctgggtgcttggtggctgctcgttggattctccctctgcactgatgcttgtgcctaccatcaagagacctttaggtgagctggctcagcctggccctgcccactgtggctgctgcctccctgggagctgagcagggagttcagaccactgtgtactccacaagtcagcccatttcctgaggcaacagagaacttttgccagtaaacaaggatcaagtatatacccagctgcattggccacagctggctgtaacccataaggtacgtctactggcttctaggtgaaactgcatggcccaatataaaacctgccgacagatgtgcataatagggctatttttggcaaagaaatagggctatttttggcaaacccaaaaactctgcctagcattttctacggtcacattccgtagggaagaggggaaagggaaagaaaaaaactataaggaaagataaagaaaaaattccacttacgtgaaaataattacacaaattagaagtgccagcatccccagatgagaaggaaacagtgcaataattctgacaccatgaaaaatctgaatgtagtgataccaccaaaggatctcgctagctctccagcaatggtctctaaccaaaatggaaactcaggaatgacagataaagaattcaaaatatggattgcaaagaagctcaatgaaatccaaggcaaggatgaaaatcaaagaaacttctaaagcaatccaggaaatgaaggatgaaataaatatctttaaaagaaatcaatcagagtttctggaattggaaaaaaaattgaaatatttcaaaatacaattgaaagctttataataactggacgaattggaagaatttcagagcttgaagattagcctttcaaactaacccagtcagacaaaaataaagaaaaaagaatttaaaaaaatgagcagggaagatgcggtagctcatgtctgtaatcctggcactttgggaggccaaggcaggtggatcatgatgtcaggagttcgagaccaggctgaccaacatggtgaaaccctgtctctagtaaaaatacaaaaattagccaggcatggtggtgtgcacctgtaatcccagctactcaggaggctgaggcaggagaatcacttgaacccaggaggcagaggttgcactgagccaagatcgtgccattgtactccagcctgggtgacagagtgagactccatctcaaaaaaaaaaaaaaaaaaacaaagtctgagaaatatggaattatgtaaagtgaccaaatctatgaattattggcatagataataattctctcctcttctctcttcttctctcctgagagagaagaagaaaaaagcaacaacctggaaaacatacttgagggaataattcaagaaaatttccctaatcttacttagagaggtaagcctccagatacaagaaatccagagaagacctgcaagatgctacaatgatgaaaatcaccaaggcgtataatcaccagactgtccaaggtcaacactgaagaaaaaaccttaaaggcagctagggaaaaaggtcagattgcatacatagggaaccctatcaagctaacagcagacttcacagcagaaactttacaagccagcagagatcgggggcctgtttacaacattgttaaagaaatgccaacctagaattttatatctggccaaactaaacttcataagcaaaggaaaaataaaatgtttttcagaatagcaagtgctatgggaatttgttatcaccagaccagacttacaagagctccttaagtgagttctaaacatggaacaacataactatacctgctatacagaaacacacttaagcacatagcccaaagaccctataaagcaatcacacagtagaaactacaaagcaacaggctaacaacttcacagtggatgaatagtaatcattagttgtctaagtgccccacttaaaaggcatagtgtggcaagttggataaaaaaccaagacccatccatctgctgttttcaagagactcatctcacacataatgacatccatagcctcaaagtaaaggactggagaaaaatctgtcatgcaaatgggaaaaaaaagcagggattgctattcttttattaaataaaacaatgtaacaacagtaaagaaggacaaaaaagggcattatgtgatgataaagggttcaattcagcaagaagacttatcttaaatactcaacattggaacatctagatttataaaataagtacttctgaacctatgaaaagacttagatgtctacacaataatagtgagggaactttgacaccccactgacagtgttagatcattgatgcagaaaactaacaaactccgggccaggcgcagtggctcacgcctgtaatcccagcactttgggaggctgaggtgggcggatcacgaggtcaggagatcgagaccatcctggctaacatggtgaaaccctgtctctactaaaaatacaaaaaattagctgggcgtggcaacaggcgcctgtagtcccagctactcaggagactgaggcaggagaatggcgtgaacccaggaggtggagcttgcagtgagccaagattgcgccactgcactccagcctgggcgacagagtgagactccatctcaaaaaaaaaaaaaaaaaaagaaattctggactcaaatttgacacattaccaattggacctcatagatgtctacagaatactccacccatcaactgcagaatatacattattctcatctgcacacagagtatactccaagatcgaccacatgctcagccataaagcaagtctcaataaattaaaaacactagaaattataccaatcatactctcagaccacagtggaataaaaatcctctgctctctcaaaaaccacacaattacatggaaattgaacaacttgctcctgaatgagttttgagtaaacaatgaaattaaggcagaaatcaagatgttctttgaaataaatgaacaccgataccacataccaaaatctttggtatatagcaaaagcaggattaagaagaaagtttatagtgctaaatacctacctcaaaaagttagaaatatcccctattaatgatctaatgtcacacctagaggaactagaaaaacaagaacaatctaatcccaaagctagctgaagaaaataaataaatcagaaaagaactgaacaaaattgagactccaaaatccatacaaagaattgatgaagcccaaagttggttttttgaaagcataagcaagattgatagactgctagctaggttaagaaagaaaaagagataagatccaaataagcacactcagaactaacaaaggtgacatcacaagtaatccctcagaaatacaaaagatcctgagatgattataaacatctttgtgcccacaaagtagaaaatctagaaaaaattggataaattcctggaaacacactatctcccaagattgtataaggaagaaattgaaaccctgaaaagactaataacaagttccaaaaattaatcagtaatgaaaaacttatcaaccaaaaaaatccctgaaccagatggattcacagcagaattctactagacatacaaagaagagctggtctcaattctactgaaactattccaaaaaaatcaaagaagatggactccttcctaacttattctatgaaaccagcatcaccttgataccaaaacctggcaaagacacaatgagaaaaggaaactacaggtcaatacctctgataaacatagacacaaaaattctcaacaaaatgctagcaagctgaacccagaagcacatccaaaagttaattctccatgatcaagtaggcttcattcctgagaagcaaggttggttcaacatatgcaaatcaataaatgtgattcactgcataaaaatttaaaacaaaaaccatatgatcatctaaacagatgcagaaaaagctttcagtaaatctaacatcctttcataatgaaactctaaagaaattagtcattgaaggaacatatctcaaaatagtaagagccatctatgacaaactcacaaccaacatcataataaacatgcaaaaacttaaagcattctttctgagaactggaacaagatcaggatgccctctctcaccactcctattcaacatactactggaagtcccagccagagcattcaggcaagaaaaagaagacatctaaataggaaaaaaagaagtcaaactatctctcttcacttttgattctatacctagagaaccctaaagactccaccacaaggctcctagaactgataaaggacttcagtaaagtttcaggatacaaaatcaatgtacaaaaatcagtagcatttctatacatcaataacattcaaactgagaacccaatcaagaacacaatccaatttaaattagccacaaaatactacctaggaatacgtctaaccaaggaggtgaaagatccctacaagagaaatgcaaagtactgctaaaagaaacatagatgacagaaacaaatggatgaatattccatggtcatggattggaagaatcaatttcaaaatggccatactgcctaaagcaatctatattttctatgctattcctatcaaactactaatgtcacttttcacataactagaaaaaaaaactattctaaaattcatatggaaccaaaaaacagcccgaatagccaaagcaatcgtaagcagaaagaacaaacctggaggtatcacattacccaacttctaactatactataaggctacagtaaccaaaatagcatggtacactacaaaaacagacacatagaccaatggaacacaacagaaagctcagaaataatgccattgaccaagacgatgaaagaagcaataaaaattatgaagacagaataagaaactatgaaaatcaacaggcatatttaagaaaaataaaggcattttttagaaatgaaagatatatccattgaaattaaaaccatggtagacaaattaggcagcagtttagacacagttgaagaacttaagaaaatgaaggacatatttggggccataacctataatttatgacctagagaaagaaatggataccacagaagaaagactgagagacatggaaggtagattaagttattttttttttttttgagacggagtttcgctcttgttgcccaggctggagtgtagtggcgtgatctcggctcactgcaacctccgccttccagtttcaagcgattctcctgcctcagcctcccgagtagctgggactacaggcatgtgccaccacgcccagctaattttttgtatttttagtagagatggggtttcactgtgttggccaggatggtctcgatctcttgaccttgtgatccacccaccttggcctcctaaagtgctgggattacaggtgtgacccaccatgcctggcctagattgagaagttcgaagaagcttcagaaagagcatagagagtaggaagaagagggcactgtcttaaatatattggctaataattttccagaagtacaaaagatataaatccttaagttgaggataggattaagtgcacttgaacacaccaaagtgaagttgcagaacaccaaatattgagggaaattcttggaagaaaccaaagataaaatacataaaatgacacagtccttgattattgttttctaaaactcaagagtaaaataaggtgttgttataagaaagttggagaaaactatgagaggagaatgttgagaaaaaggaaactgtaagaaatgaaagaagggaatagtttcaagagtgttaaataggggagatcacagcacttaaattcaggacactctactcctggtttgtcacttactacctgtgagaatttggctaggttacctaccttctctgaataagaacatgcatgtgttctggttttatttcgataagcttcaatcatcagcaatcagcccctctcgcacagtgatttttattttccactgaaagagcccaatgtgctgtattgtgaaggtgttagacacaaagatgagagaaagcatgaagttagcttcctgtctggcagaaagaaagggtggagaaatccagaattcgaagaagcagccaaaactcagcctccacctgtgatagagtgccctaggcatttaggactaactgaggctttgaggccagcaaggaagtggtttgcacggagcagaggtgcccattcgatgtctcaaaccacagattcttgctacatctgctccaggctgtgacttacattttactcatggggttgggttctgtttctgcaagtcttgaacatgcttcagttttgagttgctagtcatcactctctgtaacttgcaagagacgcccctgaggtttcgctgattcaagtagagcagaatataaacttattatgaagcataaagcatgagagaatcaaacaagttcagaaaataaattgcatttggagctaagtgaataatcttccctacttcttgggcagactggaacaaggcacttgtctggaataacaactgttgcgtgagagttggcatttgattgcctttattatccagagggctggcatcagcatgaggaggggtgaggggtgtttcatcagtgtagagttgctggattggctggacactttccagctctgatccataatttataccaagatgggaatagcaagcaagacactgcccattttcagggcttttgcttatggacacaaacctatcccactaaatcccttacagaggagacttaatgggggcttttcatagctctgatagttagttccagactggctgctgccttaagaaagagacaaatgaaaggtgctagaggcaagctcctatgatgacacatgatctttgcatacccaacctaagtaaaaattaccttgccatctacttcttcatgtattgatagtcttctagcacaggaagattgtctgaatgagtgaaggggccacaagactctgtatttctagagtgttaggaagcactcctaaggactctggctgtccgggaatggggacaagaattagcatcactctctaggttgaagcattagatggacacacaaaacaatttagaaatcctgggagcatttgtattcccagtgcctctctctttctttcctatgtttatctaataatgtgcacagaattacactagtacactttttgtaaactgagttgctatttgattctcatgtgttattttgtttacatacacagatttacgcaggaaacagacaaacctagtcactcatgttgtgcaagaattcagtgcactgtcttgtattaccagtaggcttttttatattagttctagaaaagaaaaaaaaagtaggaaggaaaagaaggaaggaaggaatgaggtagaaagatgcatgcagaatgtgtatgtccattgccgcactattcacaatagcaaaggcatggaatcaactcaaatgcccatgaatgatagactggataaagaaaatgtggtacatatacaccatggaatactatgcagctattaaaaaggaatgagatcatatcctttgcagggacatggatgaagctggaagccattatcctcagcaaactaacacaggaacagaaaaccaaacaccacatgttccgacttataagtgggagctgaacaatgagagcacatggacacagggaggggaaaaacacttactggggcctgtcgagggagggtggagggtggggagagcattagggaaaaagctgatgcatgctgggtttaatacctaggtgataggttgataagtgcagcaaatcaccatggcacatgtttacctgtgtaacaaacctgcacatcttgcacatgtaccctggaacttaaaacaaacaaaaaatgcacttaaaaataaaaaagaaagatgcatgtagggtattattttaattcattcatttaccaaatatttatcaagtgtctggtatatgccagacacttctagtcaggagagatgcggtgagtaggaagcaaaaaagataaggtcttgccctttgagtttgcaatctagtgaagggacacataaactgattaattgaaatggttctaaaggaaatggaagaaagaatagcaaaatggaggataaggggacatggggacatgggctctgaattatgagaaaaggtcaggaagtctctgtgaaaggtaacagttggaggagagagacttggagaactcttcttggcaaagaaaatagcaattgcaaaagtgcatttgaaaacaacatgttttaaatccccgagacaggaatgtgcttggtgggtcctaatcagggaggtcaggtggctgaatggggagaacaaggtggagaggcagaggtaagttctgagaggtgacgagggcagtttctgcagacactggtagcagttgtagggatgctggctttttctttgagtgatttggcaccattggtggcttgaggtagaagagtgatacgttatgttttatttattaaaggaattactctggctgttatgagggcactgtgaagggataaagtgacccccgaagaatcctttgctctgatccaggaaagcatagtggtaactttgaacagaaccacaaaggtaggggggtggctgtattttggacccattttgaaggcagaacaacagattttgctattggattggacaaaggacgtgcaagaaagaaagtcatcaaggatgactcccaggataaatggtttgaatgggctgcccaaactggaaccaggaaaaccggtgtagagactgttctcagtcatccacgtaaagctagagcttcctggaccattgaaaaagagtcgtgagagtggatctccttgctctgctctcaatgctaggaggacagcactcagtctttcaccattatatgtcatgttaactgtaggtttgttgtggatgattattatcaagttgaggatgtaaccctctactagagggttacaagtgttcctatttttctgagaatttttatcataagtgggtgttgaattttgtcagtgctttttatgcgttaatatgattgtgtgatttttctttagtttgttaatatggtagataatacattgctttatgatccttcatccttgaaggaaattttcactagatacggaattctgggatgaaagtccttttctttcagcacttgaagaatattgtgccacttcatttggcctctggtttttgatgagagatacactaccattcagttttttccccgataggtaaggtgttatccatttcttgttgtcttcaagaacttttttctttatttttcaaaatgtaattataatatgtcctgctctagttttctttgagcttatcctatttggtgtttgcccagcttcttgaatctgtaggttgtttatcgcgaaatttggcaagttttaaaccattatttcttttagttccctttttggctccaccatctttctcctctaatttggggactccaattatatgaatgttcgatcttctattttgtctcacaggtcattgagatttcttcttttatttcagtgaatttttttctgttgttcagattaggtaatttttattgctctatcatcaaggtaacagattcttctttccctccattctgctgtttagcctatttgttaattattttttattatagtaattgtatttttcagttctaaagtttttatttcggccgggcgcagtggctcatgcctgtaatcccagcactttgggaggccgaggtgggcggatcacaaggtcaagagatcaagaccatcctggccaacatgatgaaaccccgtctctattaaaagtacaaaaattagctgggcgtagtggcgcatgccttaatcccagctactcgggaggctgaggcaggagaatcacttgaacctgggaggcagaggttgcagtgagccgggattgtgccactgccctccagcctggcgacagggcgggactccatctcaaaaaaaaaaaaaagtttttatttcatccttccttatatattctacttgtttgccaaggacctttttaattttcatttcttctgaagcatttttatgataactgcttaaaatctttgtcagctaattctgacatctctgtcttctcagtgttagcttctattgattgctctctttcaggacaattttcctgttttttatttttatttttgtgtgatgagtgattttttgacggaaacctgtatattttgagctatgatattatgagactttggatcttatttaagccttctgttttagctagtgtagtgagttgaatattgcctccactgccccccccccattcatgtctattcagaagctcagaatatgatcttatttgaaaataggggctttgcagatgaaattaattaagggtcttgagatgaagtcatcctaggtttagtgtgggccttaaatccatgacttgtgtccttgaacatggaggagaggatacaaaaagacacagggaaggacatgtgaatgcagagcccaagattagggctatgctgtcacaagccaaagatcatctggaggctccagaagctggaagaggtgaggaaaaatttcctctagcaacttcagaatgggtgtggccctgaaagcacgttgattttgatttctggcctccagaagtgtgactgaataacttaatgttgaggtaagccaactaattggtggtaatttgttatggtagtcctaggaaacaaagtggcttcctctatacctatctggtagaggaagggtggggatgccacggttactgccagaattgcgtatccaggttttccactaatcctctgatgatccccaaaggaggtggcctctaccttgcttctggttgggggtgaggattctggctgcacactaagcctgcattggtaccactctgactgggagggcaaggtgcagaccactactcctcacgtggtgtcttctgacacctcattattactggtaggtggtgaaagtccctactctcactagggctcctctgataccaccccagtggggagcagggctaggcttctcattactgctggggtaggacgtgggagtccaggcttctcacatgcaaagtccaggtctccccctgacactgcaggttccctacctggccttttctgacacacctgtgtgctgggaagtggcccacttagggtgcttcattgggacctgtccagagtggaagtctagtctccctgggttttttgtgtggtgtttggctggaatgttattatgtaaaaattttctgacttgctaggctgcccttttcctgactagacagagcaggcttttatgggggtctttttgtttgtgacaattggcatttctgggttgctgacttgttcagctccaagtttaggatgtaggaggcaaaacaagaacaaccaacctaccctgaggtcattcttgggtcctgagtttctgagctggtccaccttcttctcttcacttttcagatactttttatatttgtgttctatgtaatgaccagggattttagctgtacttagtgggaggactcaggaagggtacatctactatatattcccagaaatggcagtcctcaggtgccttttaaagattcctcatgtcttcattcttgccagattgtagaacttatcatttcatgccctttcctcatgtgtatcattctcgggcactacaaagatctaggcaatcctgttagattagaaatgtaactatgagctagagaccaatcgagttgcccaaactcaggagggccccgaaccttgatgagattttggtcagaaatgtcctttgtccttccttgttacttgtgagtaggccacttgagtcattgctttaaggaggaaggaacattaatagtaacacttttttttaagaccaccttcattttagaatttactgtaaaatttatcaaaaaaggctagtccttccagagtgaataagatattattcaggttatatgaatatttcgtgaacccagatgttaaaataagtaattactttctgaaatactggtttgtgaaaagcagtgggctagtgttctcctcccccagggttttctcatgctaatcaaggctactttctgaagatgaacgctttctcaattttgttttctgctctgtatgtttctccgcttgttatctaacatcctttttttactgctacttctctgcctgcccagtactcaatgtgttcatgagcactgtctaagctttttacaggatgaacatttgggagatagccaaattctggtcttccctatataatttggtcatgaactcaattatgttccttgacttgtatatgttggactagcttttctcagaaatattgtacactgtgtgagacccaaggctatatttcctacttctttcttatcttttgggatgatgaagaaaatgctggcctaataactgatggtgaaatgaattaatgaaggaggtaaagagaatctggcttagaggatagtaataaagattaaatattttttttattagattatattattcacccattcatccatccaacaaactctcatgtggatgcctgctgtttattaggtaccttactaagcattgtacagatttcaaaaattaaaagaaacagagggacaggatgatgaataccttggacttcagggtcagaaagacctgactttagatctccgatctgccccatactaactgtgtcgctgtgaaatgaagcttctcggagctttgatttcctcctctgtatgtttgttatgatgattaaatgaaataacaaacatatagaatacctgatgtaagtaggtactagatttatgttgattattaagaaaatatgtttttctgccttaaaggagcttatagtatagtagagaaggaagaatatgttcaaagtaattagaacatttttagattttcctatgagagcagcattttgtaaattcaaaggagaaagctcacatcaaactggcaatgggttgtataagttaaatgtagttgtattgctgcacaccattcagattggcatatacagatgaatgatcttcactaacttagacatagtcttgggggtcaaggataaaggtgggtttttacatttttcttgatgtgctggacattttcatgttacccacctccccagtatcccatatctattctctagccctggagagtgattttatgaattgagaggctaatctttatgacctgcatctttgctggaatggctttgattgggtttggccaatggaagataatacaaaagattagataaagggaggaagagtgacagcatggtttttattctcccagcttcctccttggctatgaatccctccccttaagagtccagcttttggtggggtcccctgcatcccattgtcgtttctaagtacctgtaatggctccctccccttgtgtcttgaggctaggggtcttccagctagccccaggatcctgtactatccttgctgatttctccagtttcatgtgctgtttcctgccaatgcttgaaatgatgccccagtcgggttggaaattattcttgcttctgcatctcctcacagggaagatgcctcatggtagagtggattcaatccaaatagcattgaaatcatgtttgtgctcagaaaacatggattaaaggggccgtgatagattttcatggaagaacaaatattgggagaggaggggaaggcttgggaaatttttcttcttaaatgaattcactggggaaatttgtaccaacttttccagtgcctgtgggttctcaagtttcttcccttttagagaaattcatctctttctctagaatgtgaccagcaggtcctgctgttgccgctgctcgcagggcttttaatcacctgtatgaacgtctgatagggctatgaaatatggcccctgaaggcctctgagctgcctttccccttcctcaaatggtgaataatcattgaatcactccacagtttctgatatgaagctcaaatcaagccatgaaaaaacctatatttcacaaggtagcatatttttgtttcctggcggtaaatttccctcactctccctgtgctgtgggacacatttggaaaggtcagtttggcactgtgtaaattaactggagggccatttgagttgaatgaaatctattgtaaatgtgtattgatgggcatagcatgggctggaggggcatggctcttgtaccagggtgatttggacaaaaaagcagaattgtaccacgggccttagaaccactgttattgtcacactgagtgatcactggaatagtgtgatgagacaatgaatggcagcagcgttcttttccaaagcttcctttgggaggtgagtattgaagttctgccaagcacgaagccaatagcttggtgtcatgaggtcttatcccctcaagtctgagcagtgctatgcattgccaagatccagaggacaccattcccatcaacatctatgtgaatggagccccctagagttgtgcagtgtactggctgtgcagccatgtaggatagccttgagttcacaacaccacagctttaggaggaggcagcatagtccaggagttaagagtgagggctctgaggttgatggtcctgggttggatcacaggtcttctgcttgttagctgtatgacctagagcacatcattcaaattttctgagcatctctgggtatgcattttaaaagtagtgatagtaataacacctccatatgtgattttgattataaaatcagataatgcaaataaggcaccttgctcagcatgataagcagtttcacaatgttaactattaatgttcttattacctaaaatgtaggctctttctggagccccagaacccattgttgtcagaaatgataataattaatggaaaaacatggacgggaacttgatttgccatgccctgttcagagccctttgtttgtacttgactcctttccttttcagagtcatataatgtcatcagtgaacagaggaacataattttcctacaattaattatttaatcaatctattcatttgtttaaagcatattaattgagcacctcttctttttcaggcaccgttttagactctggggagcagcagggaacaaagaagacaataaacaaatcatgtcaaaagttctttacactgcctctactggtctgcttgagctttatattaaccatcttattttacctgcaggaaacatgcgtttaggagagagagagaacatttagacaagactttttttttttaatggaaagtaaagctataactattattcaaatgccttggctctgtgctctttttcaggagactctgctgctgctaagccatccccctggtgtttaacctcccacagtttgtggcaccaatagtgcatcagcgagcaacattaattatgcacctactatgttccaggcactgtgctaggcacaaagaatactgtcgtgaacacaacagaaatttattttcgtatgaacatagacattaaagaaagtttgaaagtaattacttaactaatagtaaatgttcaaagaagtacctctaactgtaaggaagcagtcaagggaggcttttctgtggaagtgacatttacactgagacttgaaggatgaccaggagttgcaggggaaaggcaggtatagggagagcagcttctgaaatctctaactttttctaaaagttgaagatgttgggccatttttctagtaagttttttcccaattgagggcttgacaattgattggtcaataaatatttgttaagtgacagaatgaatagatggatagatcatccatcttcagtgagtgaatgcatgaatacataaaatcttgcattaggaaaaatcctgaagattctctggatcagggtcattggcattttaataggttgaagagagagagttatttaccatccttactccttggccttcttcttgctgatttttggctgctataatttctttcatcaattctctcttttcttttgactagacatacacagctcttccttttttttttttgagatggagtttcactcttgttgcccaggctggagtgtaatggcgtgatctcggctcactgcaaccactgcctcctggattcaaatgattctcctgcctcagcctcccgaatagctgggattacaggcgtgtgccaccatacccagctaatttttgtatttttagtagagacggggtttcaccacgttggccaggctgatcttgaactcctgaccttgtgatctgcccatctcggcctcccaaagtgctgggattataaggcacgagccactgtgcccagcccatagctcctccttttaaaaagtacttagttgatataggatataagctcattctttcttttcttttctttttcttttttttttgagatgaagtctcgctctgttgcccaggctggggtgcagtggcgtgatctcggctcactgcaagctgtgcctcctgggttcatggcattctcctgcctcagcctcccgagtaactgggactacaggcgcccgccaccatgcctggctaatattttttgtgttttttagtagagacagggtttcaccatgttagccaggatggtctcgatctcctgacctcatgatcctaccacctcggcctcccaaagtgctgggattacaggtgtgagccaccacgcccggccaagctcattctttatggtcaagtgaaagctcattctttatggtcaagtgaatagcagcactgctgacctggaaatcttacacattgaagaggaggaatcaggaacttctgaaaaatggaccttttgtaattagtcatagcttaacatccacaggaagaagcttgtgcttgtatacctctgttggaagctttgagaatccatgcccacaatgtgccatacagcaagactctgcctttgggtccaagcactggctgttttgtgttgatctgttgtaggtcaacttggaaggctatgaaaaattaccccatctgatgcttcgtttacacaatatggatcctggtggagctttgagggctttattaataatagcatctgacggtttattgaatatgtggtgcccaattactggatttgacagtaaaaggtatatattaatgacttgttagggctgacctggatggtaattgattactaatgaggcagacttgctttcatctaggcaaagtaagattttgtaactcttttagctagccctgcatgaatgccttaggagaagtgatctactaaatggatgataaatatttcatgaagagcattttacaacacccatcttactaactttttaaaggataactagatggttactagaaagtcccaggtggcaattgtctttggtgttcaaaattcatgatgtgcaggattggcccaaagtaattatagtcattgctagatttatcttgctacctgtaacaacagggttacgtcctagtagactgagcatgttttcctgcaatgggtgagtcattggcaagctttgttttgggttcacagagacaaagcctattttatgcaagcatttcaaatgtcgcaagaaatgaactttttctagccacagctataattgctcactgatacagaggtgaaatattttcctttctttttggttctgaattaagtaaatatatgccttcctgaagatgttgcatgtatattttctataaaatgctctgaatatgttttacaaatttcagttttccatctgacccttttcctctttatattaatgaatttcacctaattgaatgaaatgccacaactgacaagagttcattctgaatttgagcttcatatccccaagaagacattttcttagtaacacttagcaaaatgatatctatcaaatcactggtgcagttagaatttaatttgctctatcagctgccattgtcatgctacttaaccttaaaaaatgtaattttcctcaagacttcataattccttttacatttcttcttctttttttctcattgctttaatttaataaactattgaatgagaaaaggctgggtaagagccattcttcacaaggtgacagggaaggagtgaatctgttgtgtccccatgcgtttccaattcacccctacttctctttcacctcccagctggaatctgatgctttccatgctggctttcctcctgttgctagtccacagcatcttcttaaggaaggggaaaggaacttgccgagaagtgggagagaaaagaagaggcagcaagaataagaaaataaaaggaggaaataaaaaacagaagaaataaatagcaacaaaggggaaagaaaaatgaaagggagaagcaaattgtgaaaagtcaaagaaaccagccccgccttgacccctacctactgtgttttcaccttagtgaatatgcagctcacaaaaatatctccctcttctgagctctgcagggcactgcttcgcaattactggtgatttttcctccaggagacttttggcaatgtctggagacacttttgatgatcaccactggtggtaagaatagggaggagggccaggcgccgtggcttacgcctgtaattccagcactttgggaggctgaggcgggcggatcatgaggtcaggagtttgagaccagcttaaccaacatggtgaaaccctgtctctactaaaaatgtaacaattagctgggtatgatggtgcacaccagtaatcccagctactcaggaggctgaggcaggagactcacttgaacctgggaggcagagattgcagagagctgagattgagccactgcacttcagcctgggtgacagagcgcgactgtctcaaaagaaaaaaaaaaaaaaaaaagcagagaggaggatgctgcagtgggttaaggccaggtatcttgagttgaatagtgcccctcccacccaaattcatgtccattcagaaaactatgaatgtgatcatgttgaggaagaggtctctgtagatgtaatcaagataagatgaggttatactggatcagggtgggcccaaatccaaagactgttgtccttttaagacaaggaaactttggacatggagacacagacatagagaaaagatggcaatgtgaagacagatacagagattgggattgggctgctacaagccaaagcatgccaaaggttgccaagaaccaccaaagactaaaagaaacaagaaagtattcttccttagagactttggaggaaatatggcctggtaacatcttgattttggacttctagcctccacaactctgagaatataaagccattgttttaagccacttgattcatgtggaaacaaatacctaggaaattaatacgctgggaatggtgctagacagtctacaatgcacaagacaaccacctataacaaggaattatatgatccataacattaagaatgatgagattaaaaaaccctgctatagatcttaagtctataggtctcctcaatattttattatgtatgctttgaggtgtttctatgtttgcaatttctcacctgattcctatacgttatttaagtttttgggactttgtgtgttggtatgtcaagtaatttgttaactcttgaaaggcatgtgtttgcctctttgattcctttaatgttaattgatatgtacatagtaggaactcaataaatgcttcctaaataaatgaacaaaaactgttagcacacaagccagttgcaatgaacctgtctttacttctgtcagtagagcatattctgaggtcttgaggttgtacttttccaagttgtgattgatgttccttaagtttgagatgtctgtgtaaatcctgtcaactcagcaaagaagttctgaagtgaaaaagacatagaagaagcatggcctattggaaagagctctggaaggaaagagaagcgttcaatttatatatctttgggcaactcacatgttctctctgaacttcagttttcctttcaatgaaatgcaaatagtgaacctagtttatagaattgttgtgaagatcaagcagcttataacataaagaccttgacaaaagtactaagcaaaacttttaatttttgaccatgcaaaaagtggaagaagcatcttctcctggttcataaaagtgtcacataccaggagacataaatgtctgtatgaggcagctatgagttttgcctgggaaatacagatcatggatgagggagtaatgcttaacactgtgcacctcctgtgtgccagggatgttttcacattttctctttaatttttaggacaaccttatgaggtggcaattgctattctcaatttggaaatatgagggaggtgaaactcacaaaaagaatctcacaaagagctgcagtcagtattgacagactctgatttaatattaaagcccaaaatgtatcaactgaacatgttgcttttcaagctgatgtgaagtcttgagtggttgtttgacaaatcaaagaaaggtgatgagcccatgttgtattggaacagaagatatatgaagataatatgaagtgagcatgtgctggtcgggtgtcatctctgtgtaagacaatgtttctgacccgcctttgctgttccgtatacataggctgtttttctctagtagcagtagtaagttatacatgtgcttggtctccaggatttgcctgtaatgcattaatagtggtatctacggacacgggctagagagaaaatgatgggccatggtctcaggagtcctacaaggcactctgttgagttagctagtttcagaagtttggctatcagagctagagaatgacaatgctaaaggtctggaaaacacgtcaggatattacatggtaatccagaagaatattccaaagcctcttgttatgctcctgttaggaatttatactctggcagcttctctgtgaaactatttatgccctggtggcttatgccctaatggaaaatgtgttaatccgttggagagttttcaatgagcaattcaaagaaaaagtaaattaaaaaataagggcatttaagtgatacccaagagaatactttttgtatcagagaccagaatcagggtgaggaaaagcctgtcttaaatttctctggtctgacctaagcactttgtgcatagttatgccagacctactgtcttagtctgttttgtgctgctaggctaggtaatttataataaacagaaatttattggctcatagttctggaggctgggaagtccaaaatagagaaaccattatcttagaagggtcttcttcttgcattatcccatggtggaaggacaaagactaggtaagagagaggcaaaagggggctgaatttgtccttttataacaaacccactcctatgataacagcattaatccattaatgagggcaaagtccttatggccttattacctcttgaatgtcccccctgttaatactgttaccatagcaattaaacataaatatgggtttggaggggacaggtattcaaatgatagtacctgctatccaaagaatttatgtcagaagcccacatgaagagaaagcatggcgttcctctaccattgtgtgttggtatgtcaactaatttgttaactcttgaaattaacaaatttcattgaaggttgaaggccactcctttgcacacgtgatgctataagtcttgcctttggaagacccagctttcattacttaggtaatgtggcatctgtaaatctgatcatgtgtggatattcagggtaatacttgtaccctgaatttttttataagtttacatccagaagatcaaatataaaatatatttctacatctatttctaccagagacaagtaactttgggattcttttctgtccttctgttcaccttctgccttctctacaagctgacgccatttatttctgtataaatatgacattagaaatattttcacatatccttcctttccagtttacctagttttgacaaaacatagaccaagggtgttctttgagcctttaacttacattaaaagtgtgacatctagtgtagcaggcacatgatttataggactcctcagatattctacctccttcctgtgagaagtgctgcccaatgcctgaacaacattacggacactgggggctgaccagtcacttgttctggaaaggccagactccttctctaatgctgtttctgagtagctaggctggccagtagcaagactggagttcctggttcttaacagccatttctagacttgaacagaacctcacaatgaaggttcggattgtggcatcttgagtcactaaagcaactatgatatagagaagggcttaatactctgagagatgaactctgaccaactagaaacagaagacaggaaagatacagttagaaattattccccatttcttccttttattgacctcttggaatcatggttgatctttgcaacatgtcagtaggcaactcatgtgctgagtgatctgttctatctactcatggaatgttgtgaatcaactggtaatactttcatggttttgtatctttccttgtctcctgttacttttcctttactttttttttttttggaatggagtcttggtctgttgtccaagctggagcgcattacattggcaccatctcggctcactgcaacctctgcctcccgggttaaagcaattctcctgctgcagtctcccgaggggctgggattacaagtgtgcactactgcacctgactaatttttgtatttttagtagagatggggtttcactatgttggccaggctggtctcgaactcttgacctcaagtgattcacttgagtgcctcagcctcccaaagtgctgggattacaggcttgagccaccatgcccagccactttttctttactctttaggcccatggtttgggcctctcaaagaaaggattagcactttatttcttttctgtgtctctattttctagagacctcaggttatgacaacctcttaagttggaaagtagcttaatagtcttaagaggatcatgctttggattgtgttctacatgtcagaaaaaataaaaagtttttgtttcaatgatatgaaatgatattaaaaatctcttttcttgtggagtatgttgttatttttataaagcatctgttgcagtatatatgaaactcaggaggatggaaagatggctgaccaaaacgtttagatgtgatttccaattagttttccttggtccaacaattcatatatccattgtagcttttataccatgctttgcagaaaagctgagtgagggaagtcagttggattggctttgggctatcagaaaatattcaggctgttgccaggaaaagagtaagacagagtttcacaaaactctatttgcaaaattaaattggccaggatcaagatagtcttgcagcttcaatttggttgcatgcctataaacaaggaccatcaatacaaagcaatattcttaatagcgaggatgtatctaatgggctgccactgaggtcagctctaggtcaagtttcatttcctaatgaaaggaaaagagaggactgtggagaacattaatgaaacccatcatgattccaaagtggaaggtcctgcctttccaggagaatgaaatacatgccattccaatttcttcacatttagaaagattttctaattattttgcagtgtgtgtgattttatgataaaatcatttgaagaataagggaaataatgaaagtagcagagaaatgcaggtatgaaagaggtttatcttggaaaccacaagacctatcatctggatgagttactggaattcaatttcggacagacagatttgatagagagaatgcccaaaaatggagtccagacttttagggaagaatgggagtaaaattagaaacaagggagcagacatctcaaaaaacacccgagagatgagagtcgtatgagaacccaatcatttagttatgttggacgataagaaactagagtagtggtgtggttataataaacttgatatatccttgaaaaagtaggtgcttttttctttcatgcatggctcaagacacagtgtgctgatatattacagaacaatactttaatttcagagaatgtagctctgtgaaggacactaatgaggcgggtgatttgcacttctgcatagatgcagctgctaaatggcatggctgtcatgacttccatatacttgagcatgggtattcccacaccttgtacatggaacaacagatactttctcccagaagctggtccctgagggggcatctgcatagggtgttaaggtaaaattgctccaaggtatggttcaggtagtcataggtaagcagaaattcatttgattattaggcaaatataagtggagggccagtgcagtcagctgctaaggcattcgatggttcatggtaggattgttgagagtagatgaaaatcaaagacaagtctttaacgtcttggataagagacagaccaattggcatggcctactcatgttcgttagattgtaacacaaatctgtaatctttgccattgtcagaaaaggaccagggattgaatggagctgaggtagaagacatcactaggaatgataaccaacattaaataaggttaagcggatttacaaacatgtaaaatatgaaaacagaggagagacatattagcatgatgtgcatagatctgcataatcagccaatagttttgaaatgacagttgaagtttagtatatcaaggaattcatatgatatatccattgtggaggtcagatcatggtctctcaaagatgtccttgccctaatcccttaattctgtgaatgggttactttacatagcaaaggaattttgtaggtataattaaggttacaaatcttaaaatagggagattattgtggattattaaagcaagcccaatgtaattgtacaagccattaaaaacagagaccattttgtggctggaatcagacgtggtagaaaggaggcagaagagatgtggaagccagaaaggctaaaagcatgaaacaaacttgatgtgctgttgtggactttgaagatggaggcaggaagctgagagagacacctagttgacagccagcaagagaatggggacttcagctctacagcaaaaagaaatctgaataaggccaaagaagattctccacctagcctccaaataagagcccaggccaggtgactttttgcttggtaaaacctatgtttggcttctattgtacagacctgtgagatacatgggtattgtctgaagtctttagatttgtcataatttgttatggcagcaatagaaaactaacatattcacatatttatgtttacataaaggtatatatgttcttctttagtgtgggaacatacgcagatatttcaggaaaagtatcatacaccatataacatattagagtaaataaatggttcatcggtcaggtatacatagctttatggtcaattgcttctggcacacaccaccaaggattggtctggaagcatgatgcattttgatcattttaaacttcttccatgataaattaaaaaagagattccatgtgtgaaattatcatactatctgcttttgagggctgctggctcctatattttgtcagaaattcaaacccatcttcagccttcacccaagcttttgccaaacttgacaaatcttccagccaatattatatgtatgtatctgtgtttatgtgtctctagtatatatacatgcagatatatagttgccattttcaaagcaattttataatgtgttaagaatacaacagaattggtcctgctgaaacactgagatgcccactttctatggactggggaacagcaggtgaaggggggcatgaggctttggtttcttatcaacactgggcctatccttttctcacagtgacatctcttggaggtttttcttatttgtgcttccccatgttttgaaagctcactcatgattttacccagagaaaacagctcctgcttcattctttgcaaacatcctgattataagaatttaatgatgcactcatgggagccaccactctgcttgcctgtcttcttttcagcaccagactgggatggacagtccccctaggcagttgggcagtatgtgtgcactccttatgtagtcaacagagctatcttctgcgttttaaatctgagtgtggatactggaaaatgctaatttatggtaagcaagagctggattgacaggaagcacatagcagagggagaggccatttgttgaggctgggaaggggtaatggaaatggaagtgagaaatagagactgatgggaataaaatcaaagaggttaaaaatagaatggcttagagttaacccagagaaaggcctaagactttattgtaagtagaataacttagaaaaagctatttggatttatatctacgaagatagacgtgtgtgtgtgtgtgtgtgtgcgcgtgcgcccgcacgcacgcgcatgtgtcagagaatagggaaaatgaaaaaaaatagctaagggagttaaataccttcttggaagatcaactaatgtccagaccttgagtttatatgctgagaaataataagggtggccttgtttttttccaaagctgagaggaaatgagaggcaagcttgctggtcttaggctagaatccaagcagatgtcttagagtggatcagatggactcagcacagatcccatgctgcatcccatgtgtttgatgatcttctgagtctttttaccctgagaattgtactggaaggaagtaagaagcagggctacagttcctgagacaagttttttgagttagagcaagagttaaggctgtctttaccatgggcaaacgaggaggtattccttttggtgatatccccggcaatttgctctgtagctcttctgtggaggatgctggagaagcaaggcgatgcagattctcattttacatttgagtcagctgagtcccacaagggtaccagaattgtccaacattacacagtaagcaacatacgtaccaattgatgcaaatactctccatttttctcaagttctaaaacaattctattcccatgttgcctgagaataaccttgtttccggttttgttgtttttgttgggcaaacattggcactaccagcgtagagcttattcgtgaatgaaagaacatttgaggactcagaatattttaacgtggactaagtaactcagttggaacatgattgttatcttcacctaacagggagtcatgtatgtaaaagagggatttacttaaatccctgtggtcctagagggctgatgaaggattaaagagtagtagcaacaggaaaacagatttcaacctaggataagaaagaattttcttccagttagaagaatctaaaatggaattagctaatttgtgtgataatgaattctatgtcttctgaggtaattaagtcaaaactgaatgatcatttgccaggatgctgtacagagaattatagaattggcgcaacattggagtgggcttgtgcttgataacccagatattaaaattcactgtttctatcaaaattaaaatgactccacctgaacttctttattttattctttcctatttgcctttgatttctactctccatctaagcttttatttctatgtagggtaaaaaagggccttgtggttagcaaagtctaacttaccttcctggattcagtcctctctttttcatttcctgtctgatttactcataaagttatctacttccctcctttacctttctaatatcttctccagggcactttctttgctttaacatagcgtgcttctttactaaaataatgttcccttaactctgccactccttgtatttccaatctgaatctttccatgaagcaataatttgtgaacaattttaaaattaaaaagttggcatttctgcttccccaattcatgcacaggccttaaactcttaacatatgactcttcttgcccctcacgtttattgcggtatacctgacaaataaaaattctatatatttaagaggtatgcaacatgatgttttgatgtgcagatacattgtgaaatgatttccacaattaagctaattaatatatctatcacctcacatacttataatttttttgtggtgagaacaattaagataaactcttttagcaaatttcaagtatgtattaataactcagtattattaactatggtcagcatgctgtacagtgggtattcagaatttattcatctctcttaattgaacctttgcatcctttaatcaatatctccccatttcccccaagctctactccctgaaaaccaccatgttacttttggtttttatgagttagaaatttttacagtccacataaaagtaagatcatgcagtatttgtcattctgactctggcttattttacttaacataatatccttcaggttcatccatactgtcatgaatggcagatttccctcattttaaggctgaataatattctcttatatatatgtacacattttctttttccatttttctgtagatgaacactcaggttgtttcaatatcttggcggttgtgaattatcttgcaataaacatgggggtgcagatatctctttgagatcctgatttcctttcctgtgagtgtatacctagaagtgggattgctgaattatgtggtagttttatttttaattttttgaggaacttctgtactgttttgcataatggctttaccaatttacatatccactagcagtgtgcaaggggtcccttttctccacatccttgctaatatttatcttttttaaataatagccattctaataggtatgacgttatatctcattgtggttttaatttgcatttttctgatgattattgacgctgagcatcttttcctacacctgttggctgtttgtacgttttttcttgagaaatgtttattcaggtccttagcccatttttaaattaagttgtgttttaatttttcttttgagttatttgagttccttatatattttgaatattaaccatttatcagatgtatgatttgcaagtattttttttttccattttgtaggttgcttactccattgattgttttctttgctgtttagaaaatttttagtttggtgtaatcctacttgtctattttcgcttttgttgactgtgctttaagagtcatatccaaaagtcatcacccaggccaatattaacaagcttttcctcttagtttcttctagtattttctagattcatgccttgtgtctaagtctttaaactgttttgagttgatttttatgtgtggtttagataagtgtccaattttattcttcagcatgtggatatccagtttttccaataccattttctgaagagactgttctttcttcatttagtgtcctcagcacattttttgaaattcagttgactgtacttcctcagttttatttctgggctctctgttgtattctatttatcagtattggttttcttttttttttttttttttttttttgaattccactatcgtggtttttgttactgtagttttgtaatatattttgaaacctagaagtgtagtgcctccaacttttcatttgtttgtttaagattgatttctctattcacagtcttttgtgttccatatcagttttaggacaattttttttttctatttttgtaaaaaatgtcattggggttttgacaaggattgcattgaatcagatcactgggatagtatgaacattttaacagtattaattcttacaatccttgaacaagaaatgtctttctattaatctctatcttccttaatttccttcaccaatattttgtaattatatgtaattataaaataagcatacaagtcttttaagtctttggttaaatttattgctaaacattttattctgtttgctgctattatgagtggggttctttcttaattttcttttcagatactttgtttttttgtgtagagaagtgtgactaatatttttatgcaactttactgaatttatctattggtactaaaaggttttttgctgaatgtttagggttttctacatatatatcatctgcaaacagacataattttactttttcctttctgatttggatgtgatttatttatttatttttcttgtcttatttgctgtggataggacttccagtactatgctgaatagaggtggtaagagtggacatccttgccttgtaccagatctttgagggaacacttttggctttccctattgattatcatgtgatctgtgggcatttaatatatggctttagtgtgttgaagtaagccccttgtatgtctattttgttgttttgttgagagtttcaatcatgaatggatattgaactttgtcaaatgttttttggcatctactgatataataatgtagggttttttcctttttttttttttttgttaatgtggtgtatcacattgattgagttgtgtatgttgaaccatccttgcatcccagggataaatcccacttggtcatggtgcatgatccctttaatatgccttttaattcagtttgctagtattgaggatttaaaaatctatgttcatcagggatgtttgcttatagttttctttcctttttgtctctttggtatcagagtgatgctagcctcataaaatgagtttggatgtgtgctctccttttatcttttttggcagagtttaagaaagactggttttaattcttctttgaatgtttggtagaattcaactctgaaggcttctgctccagttctttcctttttggtgaggtttttggttactgattcaatctccttatttgttattggtatgttcaggatttctgtttcttattaatttagttttggtaggttgtatatttctaggaatttatcaattttgttggtatacaattgcccataatagtcccttgtaatcctttttatttctgagacatctactgtaatgtcacctttctcttaagctatctaaaggtttatggattttgcatattttttcaaaaaataaactttcagttttgttaattttgtaattgtttttctattttctatttgatttatttctgctctaatatttattttctttcctctgctaattttgatcttttttaaaaactaatttcttaaaggtataaaatttatttgagatctttcttcttttataatgtagacatttatagctacaaaattatatcttggtattgcttttcctgcatccaataaattttgttatgtagcatttttgtttttgtccatttcaaaatgtttttaacattttaaaaatttttttggcccaaaggttgttagagtatgttgtttaatttccatatattttctcattttcttactgttactgatttctatttttattccattgtgttcataaaagatatttggaataattacaatcttcttgaatttgttaagaattgtttagtgacttaacttgtgatctatcctggaaaatgttctatgtgcaattgagaagaaagtcttctattctgctcttgggcagaatgttctgtatatttctgttaggttcattcagtccgtagagctgttcagttctgctttttccttactgatattctgtttagaagatatatcccttatagagaatggagtattgaagtctcctactattattgtgttgatgtctattttcttatttagatctgtcaatgttcactttatatatttaggttctttgatgttgggggcatatgtaattttaattgttttatctttctattgaatggatctttttgtatataataactttatttgtgttttttgacaatattttttgtattagtctactttgtttgatataagtatagctatccctgatctgtttgggttactttcacatggaatatctttttctaccccttaacttttagcctatgtatgtccttaaagctaaagtgagtttcttataggcagcatattgttgcatctttttaaaaaaattcattcagccattctatgtcttttgattggagaatttaatccatttacattttttgataggtaaggacttagtcttgccattttgttaattgttttccaactgttttgtagtttctttctttcttctttgcttctgtcttcctttgtatttgatgattttttgggacagtatgctttgagtcctttctttttctcttttgtgtatcaactagaggctgccatgaaatgtatgtaaattatcttacagttataacactatttttagctgctaataacttcagtcacacaaaaactatacttttactctctcacacattttatgttattgaagttccagtttacatcttttaatatttttatccgttaacaaattattatatctagttatttttaatacttttgtcttttaacttcgatagtagagttaaactggtttatattacaccattgcaattttagagtattctgaatttgactatatacttaccttttaccagtgagttttatacttgcatatattttcatgttactaattaatgttcttttgtttcaactcaaaggactcacttaggatatatatttcttaaacctagtcataggtttgcttgaggatccataattcggctaagttcagagggcctgctataggggacagggataggcatgtttcctggatgcctggacagagagtactggccctggactgcagcagagcaggactgaaacagaatctcaggtctgcttaagtctccatagctgagactgaggtgggagggcctgccacaagaagcatggatgtgagtcactgggttcccaggcaggcagggctgactctggactgtggtagggcagggctagagctgagtcacagagctacttcaagatctgcagtagggaccaaagtcaggtggattgctaccaagagttgaggtggatgtgtttcctgccttcacccagttccctgggtgggcaggactgcttctggactggcaggatgaagcttggagctagaaatgagtcacaggactgcctcaggatttgcagtttaaccaagggcttaatacctggggcatggacaggtgtggcttctccagagtttcttggcacatcaggctggttgcaggatggtggccaagtgaggctggagctgagtctacaggggaatggggcttctttggtctgcagctgtggccaggcttggtaagactgccactgggacaaaggcctgctttctcaaaggggatctccttggttatgagcgttgccagtgtttttcaatctcgtatctggatcctaaagctcctacaaaggcacttttgtctgcggggaatgattgccagatcaatttttgtgtgggcagatgcaaactgggcacctcctgttctgctatcttactggtgtcatttagacatactactctttcatcatcattttactgagtggtgggtacttagaggtttgttcccatattctttgtaactttctggtttaaaaaatttctcatgattataagcctctctaggatctcttccttgtcaaaacaagcagcattttctcagtccttgtccccacttgaattcttcatgacccttttgtatggatgatacatttcctcaccttctggaagccctctcttcccttgacctccatggcaggatcatactgatttcctttctattccctctcatatttctaacagtagtttccccaggaaacaatattcacctatttttcttctttctctgtatctcaggaatgtttatgattactctgtttcagctataaacctgtatgcaaatggctctcaaattcattaatttaggcctgacttgtctcccaaatccctgattcatatttccaaatgcctgctcgagagctctccttggttctcctaaatacctcagagccagcatggtgaaaacccagttgataaccctccccctgccccactcagctcttcctgctccctcttgacttgctcttccttatatcaccattatccacactattcaggctcaaaatttagtaatcagagttgattctttctcttactccataatcagtgcccagcttttatattctacctataatttctttcaggtgagcatcctgcttttctattcccccatctctattttagtgtgatgcctattatctctcctctgaccccttcttacccataatctctatacacaaagtctctgttcttttccatcataacttccatactctggaataatcattcttttcttcagacgccatcacttagcttcccttactgaaaaaattaaatacagtgtgaaattcaggatcctccacaatgtaggacccagctctccacatactttaaccaccatgaataacagccattaataatagtgaacatgaatgcgaactcactgtgggccaggcattgtgctaagtgattttaataacccaatgaagtaggtactgttattataatttgatagttacattaattatgtgctatagtcagagagttagtaagcatttgagcctatgtgaggggattccagatcctgctaccattttggtgttttattggcttatcacctactcgtaccacatgaagctttaatctggaattttaatgcgtccaccattgactgctgccccacctcccactgattggaatgtttttctacacatgttgtgttagaaaatattttctttcctacagactctttactgacccctgccccatatttgaaatcctacattatttactttgtaatattgatatacaactgtatttatttcttataacaatgtgtgcccttagcatctcagttttaatattttttatctccatagagacagaaactgtgtttcaatccctttttttatgctttaagttacttagaaaagcaccttacctacaacctggtagggtcttcatttgaattaaattggctagtagcactttaactaaatatcagaacttgtcctaattccttacaatgcacctttcatgcttttatgattattacttcttgcattagtgtttagacagcctgcaggagccgcattgatttatatgtcacacatatatatatatatatatatatatatatatacacacacacatatatatatacacacacatatatatatacacacacatatatatacacacatatatatacacatatatatatacacacacacatatatataattgatttatttacatctccagaactgccctgctgaggaaaagaaaagtctatttccacaaaagacaagcagtagtaactgaaaaagtgtcacagcaatgtccagacagaaggaaaatgttttaaaattggattaattagaattaatggcctagttttgatctcctacattagtcagaagagattcatctaagctattcaagtccatgtgtagtagtctgaaatttttctacagagaagttcatctggaagaactaattttgagttatctgaattcttctgatcctaacattttggttgggagaaactgacaatgaggaagtgatgggcacttgactgcttgctgtagatctccatgtctttgttacccaagatggaggggtgcaactgtctcaacaactgtttggaaaaataaattgaaatttaccatttgctagccctgtctcggagagtgggtaattgaatttttgcctcttatgtgaaacctattcttacattctctctctatacccatttatctctttacagagctgcctgaaattattcatatttcttattttttagccctttttctcactcaaaccattgatttttttctcaatcacacccattactttttagttctgctttctaagaacctttaagcttgtttggtgtgtgatgaatacattttttaaaatgttttgtgacagaacatttctggggtaagggagtgataaatatcaaatcaaatggaggctaggaatttaattttccctgtcagggccaatctgtgcttcgttttatcctgacaaaaattgatattttatccctgtgataatggaagactctgattgtagtgccttttcataatttgttggaaaaaaatctttttttcctcctgagaaacttgaatcaaagcagagtggattctgtgcagatagtgaagaaaggcacctgatattcctttagccctttgtgtccccaggcctggcagcaaatattttcataaacttgctcaggttctttattaaatgtgtttttttctggtttaatctgtggttgtcaccaagaaatttatctagaaaaggctgtaacacaatcctcccctacattcttcattcagctccatttcttaaattaaggaagacttgaggagtctgagacaatggctgaaaactgaccttttaagttaacacaccagaatttggttaaggctagagaggaacaaagtagtacttatttaatgaagacccttaaagagcttcctttgagtgaggcaacatttcagagatctctacatattaattcatttaatggtcatcatatcctatatgatgctgatcctatttttaatcctcattttatggttgagaaaactgaggcaaagagaggttaattgtcaatgactcaagttaccagcaagtggtaaagccaggattccaatgcagccaggatcaatactcttaatcacctactctgctgcctccacattaaattgttcagttagatgtgcatctatcctggcatcacccgtctctcccagacatcttgcccgttcttatttgttcagtctctgaactactctttggaaggatgtttcccatcatatttctttacattccccaaacaagttatgccagaagcattcaggagatgtccagactcccaaatcctggaattacttctgcctcagaggtgcagtctcagctctgtcgaaacaaactatatgatcttggggggaaaaaggttcctttactgtctttcttgtccatgtgtaaaataagatgaggctcagctaagtgattgcctttgttccagcaataaggtgttcgccttgaccccatactctgcgacacccgggcttgtggaccatgcttagaaatatgtctcatattcagtctatcttctgggggcgggccgacttgggtcagctaaaacttttcaccaaatctgagataatgtgtctgcatgtgtgaatatgtgtcttttaatttcatttaatttcatggaagcctgaccattagttaagaactgtttagaaccaagtgacaaaacccaattgaaaatggtttcaacgaagtagaaaaatctatgggctcatgtaaatcaaaagtttgggagaatggaatctttaagcatggttttatccaaaaactaaacaatgccctcagaatttagtcttttgccatgctcccctctgtgtggaatgtattttgtcagggaattctaatagacagtctagtttattcctagagatacaagtttatatgttactaattagcaattctaatatgaagggaattgcatgaagcatctttcctattaggtcaaatacaagtcctagagctacctcttaggagactgatttttgtgccagtttttaccagtcagtctgctgggggcagggtggtggtggtggtgggaggaatgatgatataatatgcaagtttcctgtgcccaaaacctagggatcatacttgcctgaaccacatgggctgaaagtagggaagcaattgttaactgaaaaaaaaaaagtttcttttaccagaagaaaagagatgcatggtagggaggaaggcaggaaaaactaagatatgtaatccgtagtatgtgaagctcagctgcctcctcccatatttacaagtgtgatctcagaaaaagaggcttttaggatactttccttgtcgtccaaacagatgacgttggtagataaaatataatttaaacacatgaaaagaacataagtccagaaataagttatcatggaccacaaatagaccagaaatttgaaatgttgaggaagacttaagtcagtggcttgctgggctctaagactagaaggagacgtggtagctagcattttactcctaggctatttctgctaaaactaataaacatgggttagggttctagagtcaggctcactatttgatgtcagagtctggagctgggtttggttcccctcccacaaagaaaagtacactgaaaaaaataaataagtgctgattcacgacttcgggatttgttttttcagaatcaatggacctacaaagtcaggaggataaagatgcatccaggaatagcaccaagatgccatagccctaatatcaccatgggtaaagagctccctaatatttctggactgggggtctgaaggtgagggaagacaaaaacagcaccactagataggtacgatattcacagacggagggagagagataaacataaacaacaaccatggaaaacccactttcaacatgaccctataacaaataaaacttccaaaatatgtcatgagaaagacagccaacaaagccagtaagaaaaccacaaattcactctatatgacatcaaatatataaaaattttatatgaagattttaaagttactacatttaggatgctcaaagtgacaaatgaagaaataatgtcaattaagaagtgtgagaattaactagtttgaaatcttgtaaatgaaaaaagtatagtttattcaaaaaagtaaatgggataaatttaatcctagacacagttaaagaaggaattaatgaagtgaaagaaatctgctcagaggcagcacaagaggaatgggataaaatatttctgtaagcacagttagtagacatgaggatatactgagaggctcgcacatttttatctgatagaacttccagaagagaatgaagggaatggtggagaaacagtattataagatgtaatagctgaaatttttgtaaaatagaggaaagatttgtctttcaaaagtgtattctgaatatcaaacaaaagaaataaagattaacccacacttagaaacatcatatttaattagcagaacaagaggataaaaagaaaatttgagaatctgcgcctgggagaaaaacagatgactttcaaagagacaacagttagactgaaagaaagggatgagcaacaaggcacaatgtcttttaaaagaatgaagttaaaagtggaagttttcagtcactgaagatgaagaaagtctaccaacaagaccctcaataagggaacaattaatggatgcacttcagcaagaagaataataaacaagagatgacaggcatgttatatgaggaatgatgatgaatatagaaattgatacattttatgagaaattacagaaaggactggctacaaaaactaattcattgtttaatttgataaagcaaactcgagatagcaatgccaatatggaagactgaatttaatgggtacttaaaatatgttaaaatttttgtcatattttggggagtgcagatgcattgtaaatacataaattttgttcagaatggttataggctaaagaaaaccactaaagtcaagacataaaatctataatttgattgacactaatagataaagagtagaatatattaaactccatcaacttaagcatgactggaaagtagagggggaaaggaacaaaaacagactgataaacacaaaatcagttggttaaaatgagtgtgtgtatgtaaccagtaataccaataaaaataattgggttaaagtaaattatttttggctaaaattaacagtttgagaaaaatgaaatcgatctccatctctgctaacaagagacatacttaagatgaccctcagagaaggtttgcagatataaacaccaaacaagcttgtgcagtaatattaatattaaatgagaaaaaaattatggaaaatctaatgatagggataacaagggctactgtataataaaaaatacaatcatgtgatctatcaagcccctaccaacagaacaaaaacagaattacaaggaggtaggaacaaacctataaaatggatgatttaaacaaatatttctaattggcatatatagaatttcacacccaacaactggatttacaaaatctaaccatattccgggtcacagaagaaaaattatcagcaatttaaaaaatcaatcaccggttttatgagcagagagcaatttacttccatctctatcataaaaaatatttagaaacttgatttttcattaagaaatcaccctagaatttaaaaatgtcttgaactgaaggacaatgaaaacattacatataaaaacatatgaggtgtagctaaatcagtaattagaaaaaattttctgcccattaaaccagtattagccactctgggtaaatcatgtgtcttggagtgaggatttacatctgcagctacctagtaagcctcattcccactgtctctattccttttttttttttttttttctttagacagaatctcactctgtcacccaggctggagtgcaatggcatgatctcggctcactgcaacctccacctcccgggttcaagtgatttttctgcctcagcctcctgagtagccgggattacaggcacccgccatcatgactggctaatgcttgtagagaccgggtttcaccatgtggccaggctggtcttgaactcctgacctcaggtgatccacccacctcagcctcccaaagttctgggattacaggcgtgagccactgtgcctggcctgtttctattctttaacgccaggacaggtgatacctgcccaaagcacagcctgtgatatctaacctgagctgatctatactactttgcctctacttatctgctctcatggcacatctccatctttcttaccgtagcattatccatgaccttgtttaatcctttctcctccttccactcctctttccactagcagtaaactatttgagggaagggatctgtatatgccctgttccatgtaagagacttgtgcatagtaggtgtgcagtaagtgttcacagacttgagtgccaaagtgatcacagaaggcacctacacatagtgcctctgcatgtgaagcatgtgaaggctcttgggtctatgggtctggggttcagagcagtgctcaagctatagacctgactttgagaatcatcagcattcagatgatatataaagcctgaaaatggttaagatcacttaggcattgactggtgtgagcaaagaaagcccaggttcaggaagagaggaatggcagcacagtccagtacagacttggagaaggggctagctgaagaggtaagaggaaaatgaggtgtgtaagtacctgcaaatctggagaaaagagtgtttttttaaaaaattaagttgtgcttcgtgcagctggtaggcaaagaacaaagagatttgaaaggagttcacaggaataaaagcaatggcggtcattggggcctggagcaaagtcagtttgaaggaaatggtggagttggacatgagattggagtgagctgcctgcataattttgtgcatgaagagctctgcctggagtgccttttcttccacccctcaagtcttggctcacagcctgtcctctgcatgtacttcatatatatcatatgtttttattatatatagttatacatatgtaatatttatcacattgcatatataggatataaataacatacacacatatacataagtttttactactacacatcacaatcattatctactattatacgtcattattatgtgtgtgtggactcccatacctcaccccggctgagaatgtgaggttttggggtcaagaccatttatgtgtgtgtcccagtttccaacaccgtgtgcagaaatgtgttatctttcccttcatagaaaatatttttatgagggtgagagacgcacaaaggggtggtgtggtgaggggaaaggctaaggcaacaacgctgcctctttccaccctttgtaatgtgttttggcacaattttggttggctgtggtaacgtagtagagagtggctgcttgtaggggggaggtgaggtgtgcagagccactgtcagagcagcatctgcctgcactcccggcagtggccacttccatctggggcgggggtacctggcatccctcagacatttcttatgctcctttgcctccccaccctcccagcatttccccgaaagtgcagtgctaatggacccatagctgctgggcttttcatcctggtataatgtggcctggggccaggcagagatggtggataggacagacccttgccttcatcagcatgcctgggcatgaagtgcatatgagttctgtgcagactccatgttgtgcttttccaggatttggaatgagaatgtcccaattcagccaagagtagcacccatttggttggcttagtcttggcctcaaatgtaacataagttaaggtcaaatgtagattgtttccccttctttccctccttccctcctcccattcatcctactcatcatttccccccttggtgtcttttatttgagtgtctcatctgtcttaaggtcaaatgtagattgttttcccttctttccctccttccctcctcccattcattctacccatcatttcctcccttggtgtcttttatttgagtgtcttatctgtcttcctttctgtctttttacctgccactttttctctctcattcattctctatttctctccattcatacatatgcacatgtttgcataaatgcaaatatatgcttatatagttcattccgatttggaatacagacttttggtttttttctcttatggtcgtagttttcctggctacctctacaatgtcacctgggaccaatacctgagaaactgtttccatcggggaggttgctctctgtctcacgccagcctggctggctagattccagatgctacaaaggcttctctggaaaaattaagaagacaaggggtagggcctatagggctctgagcagaaggtatcaaggtagttatagtgaggaagaggtccctcccacccttgctgcccctacagaccagggaatccagctgttactgggtgctaaggatgaaatttggattccagaagagtaaattttaaagtgctgggaagaactgatctaaccctgtaacccctccttttcttcttttcttttctttctttttgtttatagtttctggcacgtaatgaaatggtcaaagcaacaggaagttttgaaactagtcccacatccccttcaaatagcatgcagcctaatgggtcattacctttacaaatatacctcattgaccctcacctaattaactccttgtggtttaatcaacatatccttaggaaaaggttggtgatattttgcttgaaattctctagtctgactttttatatgcaattttcttctagagtgtgtgcctcttataatgtgattaattactttcccccggaagaagtcttggcaccctttcaacacttagaagctctgctctcatgggcagagaaatcaccttgacatgctggggcatgagcagggacagaatagtaatggcttagcatggtggagggcatgggaatcatagaaggcttgctctaaaggccaggactgggagcttggctgtattggatgagggttttagaaagttctatgtgtcagagatgaaatctaagtcttttagcagatctgaggagaaggtacactaggcaggccagtggccaggagtccagggagagcaggcaccagagtgagaatccagatcagagaaccaagcaaagaaaattgaagattcaggtggagattgtggggataacaaggtcaagagccccttggacaaagacaaaggtaacagaggaaaagctgtaggcaaagcacagcatgctggaaagaccaggggttaagtctcacattcggtctgggttcaagttcttgtgctatttacaaggagtttctccttgagcataattaacatctgtagccatttatattttacttaaaatgaaacctataaaacccctttgctttattatggtgaggtttaagtaaaattatgtgtgtaaaatgctaaatacagggcttgctgtatagtagctattactaactgataattcactaccccctgccctagacaaggtcctgtggcatagctgtatgaatgaaagttgaccgtcatacagaggttagcaggtgaggaattcctgtgggtttcttacctaagtccgacttggttgcatatttagacagaaactcaagtctagagtgtttacttgacttggtgaaggtcccagcaattgttagaaacaaagccagaaatataactcagcttttctaaattctaatccgcaggtctctccaattaagcatgtaaatacttaatggtatccattgatacttggagccaaataagatttgtatcttagtgaggaaacgtctgtggatttattacaaagcctatgaagataagtgttattttatgtttcatggatgcatcttaatgactgccctacaggtctgcatgtttgactttaatgcttgcatttatctaaatgtcataaaagtaataggaagaccatatgaaggagatgatgagaaccaggcagcaccttctttggggcatgtgacttgtcttgtgtatacactgctggtgatggatcattttgatttatctgctttcccatcccagtccctctggccatgacaacaatgattggagttagagcacagtctgtggaatggagtgagctaggttgtctatctaaaacccataaattgaggatcatcagtcaaacacttgcctcatgcatctatctggccaaaaggagaacctcagagtccttgactctgcttttagctcctgatttgctccatgggtatctctcatgaaactatttctttggaaatgtagcagggcttagttaagaatgtggcacacaggagccagactgcctgctttagaacccagcctttaggacgttttttccatattatcttgagccagtcacttaactattcccagcctcagtattctgatttgtgaaatggtgcttacagtagcacattcatcatgagctgtcttgaggataatttgggtcaaaacaaccacagtgcttagtcaatgatggatacatagtaaatgtgtcttaatttgttgtctggtcctaaagctacagattcttggtttccctttgtggaatctgtcacactccttctctactcagccacttgggttcaactcttcccttgacttttggtcagacccaaggcagcctatctgacccctggtaagatgatatttgggcatgggtttgctttgaaaggtgctgtattagccattctcacactgcctaaggctaagtaatttataaagaaaagaggtttaattgactcacatttccactcggctggcaaggcctcaggacacttacaatcatggcagaagggaaagcaggcaccttcttcacaagtcggcaggaaagagaagcatgaaggaggaatttccaaacatttataaaaacaccagatcttgtaagaactcactcactatcatgagaacagcatgggggagactgcccccatgatccagtcacccccccaccaggtccctccctcaacgcatggggatcatggggattacagttcaagatgagatttgggaggggacacagagccaaaccatgtcaggtacagaactcatgatcttgatttgtagcatcatattaaactccttgaattcttctgttctcatgtcatgttggccttttcactaatccatccctagtgtctttcatggtacctgatgcaaaaaaggtactcggctgtgctgaccacatgagcaagtacatgcagggaagaaacacagtctcttgtgtagcccttagctggccctaaaaatctgtactttgcactgctgctgcttctgtgttcagttactttatagtttactgagttttggcaaagggtagaagaccaaggtgtgggagccatgggtgaaggagaagtgaaagaatgccataaagaaatgccacttttgggccactgccaatggctaggcagggctcatgttgggaaaggaagggtggagtcctatttgacgcattcacattctcagagtctggtgagccaggcagccaaactgctatggacaagttggtgtgtcttaaatcaagttggatctgagtaggcatttatctaatatagtttatggctatgtgagcatatggagagcagaattatgctagagaggtgccaaggttttagctgagaatatggtatgtgttttaagccttcctgacaagttagagactcaatgggacaaaggagaaagatgtcagaaggatgccactgatgtcagaatcagagacaattgtcagctagatgagaagaaggtcagtgttagggatatatttttacccaaatttcaaagtctgaacagtttctgcaaaactgccctcactctgtactaactgcaagtttgggaacttcccagaatcacccttagtttccatgatttgctggatcactgcacatctcactgaaagttattacactcagtgataatttattacagggaaagaattcaaattagagctaggcaaagaaagagatgcataggacagagtccaggaggaattgaaatgcagagattctgctccttttcttcctgtggaatcctggttggcattacttcctcactgccatgatgtgtgataacaggtgtaaagtattcccaaccagggaagctcatccagtccttgtatggagtttgcattggggcttgattgcatactgcctatgtggctgacctgcagtctctctccttgcagaggctgggctaatacctttagtctccagttcctccagagcttggaacggctagggctagagcatggctcaagctctcatcttaagtcacattgttagacagtcctggtgccaaagcacccaaacaaatatactccaatcaggtagaacattctaggggcacagggggtctcctctatgtagccaaaggcaaaggccagacttatctttgggtaaagttgatgcttcattgcatagttattaactcttaaattccccttttgtccaaaatcaccttgcaaatggtggcacagggcaaaacagattatagggactctaccaagctagaccatattaatttatgatcctatctatatgggaaagccagatagagtgggccaggtctttataagtcaggattatgctggtgaggtttttctggctgggcctaatggtgcagaaccaccacggacccagtcctagccttcactttgcagtctcagatacttgattttatccattcatctgggtgcattggattatatggaccaatgccccaagagatggattttaaaaatcacaaatctattaatttataattaaatatatactcacatatgtgcatacctttactaagaaccagaagaagtcactcacatggcatgtctcagtcttgttgaggtgagccactcaggacactgaaatacatcgcagaaggcagcttattcagcacagaatcagagcagagggagctggctgttgaagatatggtagttctcacggcctgaagactggccttgcctactctagcagcatttttgctctaaaataacagtatcagactcctaaaatgagagcacaatttttcctggtcagtgctaacaagtcctgtttttccaagtctccatttttattatttcttatcaggtcccaaaggcttctctcattacattttgtgttataatttacaagcttattttatataagtgacatctcagagtaagtggttcctagtacattaatctaaggcagctttaagttaccatgtagagtaggttagggccgccctcgtccaggtgggggctgccatgctcactaggtccaggagctagatattcccagcccattcctacaccagggattcaaggacctggtgatttggaggtcatctttgatttctctgtttttatcttctagagataacgtgagcaggtattattcgtatgattgcctgaagataaaaactcatgctcataagatacatatcctgctgtggtcctctcttctttcccatggtagaagagagaccattaaaacaaataacaatggtaggaaaaaaatagattgtaatatctggatgggaatttaagtcctggtgtaacatccaggcattacaaacctgggcttcatgcttcattttgcctacggaccaacttagcatctaaaacagtcataccacagtgtgtacatatgtatgtataatgcaaatatataacactctgcataatacagcaaagaaagagtggggcaaatttcagagtttaaaatgcagtattgtcatctttttagagctggagttaccttaatgtgctgtctgccccactcaggcaaactttaaaataatatcatatttctcaaaaccctattaaactgtcacataaattccctttatttccctttcccgtcaatgctgattaccacagaagatatttctgtgtcagtggaaattttttcccttcccatcggccttcctctcttgccactttcttttgggggtctgtctccaggggccagtcttctagagacccctttgcctcagccgaacagaggaaatacaatcactcagccagccctggtcatccagtgctgtttttcatgtaagtgctgagtagcttcagcttccaactgggccattctgagagctatgctgatttcacaggggcttacaaataggtgatactgagcatttcctatgtatttggctcaggctaagctctttattctgtctcctttaatttttacaatgcagtgagatgggattattattattattattatacccatttcacagctgaacaaattgaggccacatgtaagtaacatatgcaaagtcaagccacaaattcagtggcagggcgagggttcagggcaaccaactgccccagttttcccaggttggaggagttcacctggacgcttgctttcagtgctaaaacttggacagttcttgacagagaaggatagttgatcactttagtttttttttttttctttttttctttttttgagatggagtttcactcttgtcacccaggctggagtgcaatggagcgatcttggctcactgcaaactccacctccttaggtaaagcaattctcctgcctcagcctcccgagtggctgggactacaggcacccacaaccatgcacagctgatttttgtatttttagtaaaggtggggtttcaccgtgttggtcaggctggtcttgaactcctcacttctgatgatccacctgcctcagcctctcaaagtgctaggattaccagcatgagccaccgtgcctggccggtcactttagtttagatttcagtccctctgactacctgaaaaaacccttgttcttaaccatgaaggatactgccttacccacatggaacagaatatgataatattattacataaattaatacgataatatccactcttcattatttccatctttctaaatttttatgttttacagaaaactttttaaagtcaaatttgagtggttctcattcaaactagatatggccataccaataatgtattcactcattcatttgattgagtacagtttgaataataataatataattttccttaataataatgccagtaattatacaacttaactaattacattgattgggcaattgatgtgtgccatgtactttgcaaaatgctttacatgcattatcatatttaattttgacaacaaccccatgagatagggactattgttttccccagttttgtaagtaaagctgtgaagctcagggtacttcaatgactagccatagagagtgggcagagtcgagattctgacccaagtccagcctgctcactgacacaggacatagtgatctcaacacagcttatttgcccttctctacagagtttcagagctggtttcaagggctttgcagtggagcagtccaatcttaaccatgtagctgtgtctcacttaaaaaacaactgtgagaactcttaacttttcagaaagattcatagcagggtgcttcaaaattgagggctttcaaagtaaatttaaatgatgacttgatttgtaaaatattcatttacatgcaatctgtaaggcctatctctggcacaatcctttggcatggtctaggggattgttttaaaccaaggcactagagggatgtcgttaggcttgtattaaatgacttcccggggacttttaaatctatatactgctcaggaaaaactgacgaccaaaaaattctcacatgatagacaactttggtcacacagacagatattctggacccagagttcccttcctccctctctcattccctcccctgcctgcctgcctccctccctccctttcttccttccttccttcctttttttttttttctttttctttttgagacagagtcccactgtgtcgcccaggctggaggacagtggtgcaatctcggctcactgcaacctctgcctcccgggttcaagtgattctcctgcctcagcctcctgagtagctgggattacaggcgtgcgccacctgagcccggccctttccttccttttttcctccctccctcccttccttgttcccttccttcttttcttctttcctttcttttctcctccgtcccttcctcgcttccttccttcttcctccgtccctttcccctccctcactccctccctatggcatattcatccgtctgtgtcattctctctgcttctttggtgtttgtctttctctctgtctctaaaccctgcaagaaaaaagaagtatttccattaacttcccgttcatttacaaggccatttatgcacatgcttggcttaaaaatctgttttatttggctccaactttcaaattgtgtcctttgaaagctactcattctcatttgaatcctctttggagccacatctcttaatggctacacagcagaactttttaaattcttgcctttaatgcctgccttattctcagacagggtgatatcctactcactactctttgttgttctaatccacattacttataaagtgtgtgtgtgtgtgtgtgtgtgtaccagtcactgtgcttgtttctaattactggggaaacaaaattgaattaaacacatatactcaggggccttttaaaatcctttttaggcctgaggtactttaagaattggagggcccatcatatagcatattaaacataataaaatgcaatcacaacccacattaaatatcctttttgtcactgaatttgaaaaagtttcatgtttgcttttacaactatttggctatggatgatatttaatttatgagtgactcttttgccatcattgtctgtaattgggaattcttgtgaagtgtggaaatcttacctacaaattgctttcaaagtcaatgacattcttatgaatactaaatttaacaattaatgaagttgacataatattctattttttggacaattaaatgtttatttcaatttaatagtttcttttcatgttttggagctgatacactttttttttcaggtctcaaatatttttctgaatcttacaaagtgtgttggctccaggaagactggaaacttaggggtaaaggaccctgtgtgtcttccctgccttgaggcttgttctggctcaagacagatagaaaaatctagaagtacaaggcaggatagactgaaatgacccatgctatggtagaaattagggccagacagcataggagaacaggcacaggagaacttaattcagtctctaaaggaggaaagaaggaaatcccagaatgggtgaaacacgacgtaaccagaagtccaagggagctggtcaagaagagagggcgtgagagggctttcctgcagaaggaggggcctgtgcaaagatcaggagcagaacagagcatattgaaccaaattgtactgtgggggtgcaggtgggggtctgtggcatggggtgaacatctccccattgggaaggcagatcatgaagggccttgtgcctcaataagaagtcttgattttatcttgaggccaatggggagccgctgaatatttggaagaaataggaatggagaggacggaaaatatccaaaaggtatttaggaggtgggaatgatgggacttagtaacgctctgggtgccaggtacctctgtgatgtagatgtcttgtgggactcccccaccgccctgccacatttccagaagagttgactagaagggtggcaatgcagggtaccttccccacatcagtcccaggggatggggggcaggggagtgggggacatgcccctgtgcagggttgacacatctttaagccattgtctcaggccactgctggtatgccacacagacccgcaggaaggttttaggatggcagaagtaaactttgaaacgaaggggccagaaataagtctttgagactgtttgcaagcagcaaaagactttgtatgcagatctcaatttcccattttcaggcctaaatgtgtcactaatattctccgtcaggctctctgaccagacctgctccccacacactctgttgattccacacatcctaggagttcttggcctgccaggggctctttcttgttgcccagtcatctgtaaatatacctaattctaaaggtgaatacatttaaacggcttaaacgtaaaaggccggttgcccagcaactggaaatctgaaatacccttgtcaggctatgtaagtggagaactggcaggccaccgctgtagtcattttgagtgaacagtggcaacagtaacaataataataataattattattattctctttctttttatttttctctgatttctttccttcctccctccttccatttcctaccagaaaccagcagctcagccttaattttaaaatataatagctctatttaaattaacataagcccataacagttcttaattctgtttgtggagtaacaaagcagcaaggccacttcccttttgctgacttcccccattccttgaacacctccagaactgcacaaacgacctgaactatgctaagcttcgtgagagtaaaacaatccacctctcaaagcaagtaacctagctatagaaatttcctgacacggtttccattttgaacagctctgctctggtgtcagctggtgacatctgtttttcagcttcagactcttacattttcaccttctatgttattggtccttatggctcaggactgtcatttcttcattgtgctgttctcatgtggtggtttttctgctgtctagatgtcagctgtcttaaatagccggagctggaaagggtttgggggaagcccaagattcctgagagatgctgcactgaagagagtaagcattcagtatgtaaaaaaaaaaaaaaaaaaaaaaaaaaaatcctaattgcttatcttaagtatttcactgggccgggcgcagtggctcacacctggaatcccagcactttgggaggctgagacaggtgggttactgaaggtcgggagttcaagaccagcctgacaaacatggtgaaaccccacctttactaaaaatgcaaaaattagtcgggcatggtggcggcgcctgtaatcccagctactcgggaggctgaggcaggagaatctcttgcatctgggaagtagaggttgcagtgagctgggattgcaccacggtatgccagcctgggcaacggagtgagactccatctcaaaaaaataaaaataaaaataataaaacatttcattgcacgtgagttcacattgtttcactcctcttaccttttccctgccgttcttcgctgacgtgtaagggcatcctgcaacaaaattgacccacttcagcccgctgcagtgctgcaagagcagatactttgcttctagaggaaactctgtcccggagcccagagcctgcttcctcaaggattttggatctttctcctgttctaatactttttttcaggcaaataatgtgggaaagagcagagcaagaaacatatctgacctgagagcaaaattattcactagaatgtatttcaaagttttctgaattaaatcaatagctttctctttcttcaagattgttatctcttagtgctttataatatgtctaaacctagtgaaatgtaataaagtataacagggtgggatgtgttgaatgagtcttcgtggagcatgtcacggtccccttcccatctcattttggtgatgtgtctagattgctgtaccgcgtgggctccattgaggtagtgcttagggcaggagctctggaaggagattgcttgagacttggccatgaacagccaaacagaagtgatctggccttgaggtgtcaggagctttcatgagaactcctgaagcttgagggaatcagttaatgctttcctcctggcagtgctaattttaccagggagatctaggggcaaaggagctagtagcgtgggatacaagtgagccagccggcaggtctgcaccacagttgcaaacatccctaagtgaaatcagctgatagattgatgggggcgggtgcacagcatctgtctgcaattttcctgatgcgattacacacttctcccaagtgactgccgtttctgtgtgtagtaaatttctcaaacccaacccaaatactttattattatactgtatatattacgtatcattatagcacagatgtattattttttattcccagcatattataatataacaatttccagagaaatctgtagtttgatgcagatgagggaatgcagatggattggctcatctttattcagagtctaaaattgttatctcagcctcgattacaccacttcctcttggttatctgaaaattgcccaggaatagatttgctgattttcttttcatttattcccattatgtgagctcactttcttatagtttagagacagagggtacaaaataagaaggcgagattaccctttgcaaagaaatacgagttggtaatattttgaaattggatagttttgtgagaaagaaggcagcaaaacagaatgttttgaggggaaaaaaccttattctgttattcattttctcagtgtctcagctctgttccattggggtatagtaaacttttactattcagcgtggtgaggggctttagttagcaagctggcagagggtctagggctgcatctttcaatccggcagccacgagcctcctgaggctattgagtaattaaaagtgattagtccaaattgctctgtgctgcaagtataaagtatactcccaaaagtctgataacttagcaccaaaaagtctcactcaatatctatgtctcattcatcattttttcatatgataacatattgaaatagtcatttttactatctattgggttaaaatatattattaaaattaatttcaccttacattgctttttaaaaatgtggctactagaaaaaataaaattactcgtgcgccttgtattatatctctgttgaacagggagagctttgctccttaaaagtctgattccttaattttggcaccatctgggggcttggtagaaatgcagagtctcaggcatcacctcagactcattggagcagaatctgcatttcagcaagatctccagaggattcacacacactttgaagtttgagaaacacttttctagtagaggaaaatttctgaaaggcttaaattattttacttcccataaatacctattggtttcccatggggaaagtgggagttctttgaggacagaaactttgtctgacactccttgacatcctcagggtttggtatagtctttgacacacagaagatgatatccaataaatgttgaatacatgaatgggcacatagtcctgtctgccacttcatggatgaagactctcaatggtcacataaagtgaagggttctgatgggcgaccactatccagtccaaataatttaaagtgatgtgtgcatcctttgggtatttgaagcacagaactgttttattttcatatgttaggatcctaactggttttcctatctgacttttaaaaattaccttgtttgttttattctcctcctcctccccctcccctcctcctctcctctccccctcccccatcccccctcctcccctctccctctcatcctcctcctctctccccatcccccctcctcccctctccctctcatcctcctcctctctccccctccccctcctccctctctcccctccccctcctccccctcctccccctcctcctcctcccctctccccctcctcccctctccccctcctcccctctccccctcctcccctctccccctcctccccctccctcttcctccctcttcctcctccaccctcccctccctcctcccccttcctcctccctccctcctccccctcctcctccctcctccctcctcctcctcctcctccttctttgtaaagtgaaagcaagtttattaagagagtaaaggaataaagaatggctactctgtaggcagagcagccccaggccagctggttgcccattttcaagattattttttgattttatgctagacgaggggtggattatttgtgagttttctgggagaggggttggctttgactgtggtatggaaaattatatggaatggagcaaaattacaaatgagatcgtggtatttggcacgtggtacccttttcctcacatactctttgccatccccacttaaattcatttcatttctttaactggccaagtttcctcaatccagagaagtctctgcttatctgtcacctcctcaaagagccttcttttctaaaatgatgattccactcctcctctttcaatccccattacctccctctgctttaagtaaatacccactaatgcccaggacctcaagcctgggaccttcatagtacttacatgatgttattgtctcccttctccacttcccagcccttatttggctgggactttaactctttcaccacagtccctattatagtgcctgttgcatcacaagacctcaataaataaatattctttgaatgaatgaatgaatgaataaaaaatgagtgattatgttgtttatgttgtgacataactgggcatggaggagttaatgacaggagctaattacagttaattgcacctatctactcagcaaatattttctgaataattcccgtgtagacaacagagaaataaggtatggaaagcagaaagggggatggaagagaccaaatatgaaaatggattctagggtcacatggtgagttgtacacagttgcatagatgatgttacatctatgtaacaggcgaaagggagttactctttcgcctggggcatcaagaaaagcttcaggtggaaggacaatgagaatttgctaggtagaagaagtgaggatgaacaggaaaggacacagtgtgttttgggaatagtaaaaatcagaggatgggtatttggttcaggagtgacaggaaaggagaccaattggctgggccagctggagtggggtacactttcaatgaggagactaaggactgtgggttctactacagtgtgttacctggaagatgataccatcagacttaggttttcgttttcacaccttatatgctgctgtgtggctggaccagatgttaaggaagaggttgtagtaacgcagtgaagaagaaagggggatatatgtttgagagagaaggaaagagagagggtggggcttgaaggtcctgaacattagtaggaaaatatgtgtattacttacaatttgtgaagaagctgaaaagatttaagaaaaagatttgtaggctgccaatagaatgatcattatccttcaatcagtttccaaaacttatcagctacaaagggcctgtggtcagccttggcttccatgccttcctccctgctgtccccaagaatccccagtgcggtgagtaggaccatcagaatctctgttccccgctctgccaatgtatgaatccccactcctttttggtgaaaactaagcaaatccatcactgaaagatgtcagagcttcttgggctccttgtcatctggaggtaatggaggtcacatgtcaggttttggggaaaaggcagagtgcaaagttctgggagggacagggtctggggctacttcctgtcactggaaggcgggtagggctgaagaagaacaatttctggtgaaggcaaatggtttggaaatgataatctggtcagtttattattccagtggtatatgggtcagaaagatcacagcttaagagtttgtaaaagatggcttgggtgcagacaaaccctgctcatctgggaaggaattgtgtcccagcaagagaaagccagctcacacttcgttgttctgaagctgattattagccgtgattacctgcactttctattttcttctgctaccacccaactttggaccacttttctgcttattagcactagcatctgaatattggaaaagaggaaaagagagatgaaggagctccatgtaattttgcttcctgttagcagctctattaaaagaatactgaaggaaccaatagaattaaagcagattgaaaccattgggtaaaaagtttgattttcatctaccctgtttcacattgccattgataatcattaaatttagtgcagcaaagacttaggagagccttgctttatgggtagagaacagatttcaaaagattttaattttcccaaatccattcaatcagtgagaggcagaacgagatctcaaaccaaagtcttccaattcatactttacatggtacttcttccctcactatatcatattttgtctcaataagattcattttggccttcctcttaaatctatacaggcaaaataatacataatgaaatgaaaagaatattggattttgattcagaacacctaagtttttcgcttgctttccctcttttcttgccttataagcaagatagtgataattcctgccttgcctacttcacagatttactctcaataccaaaggaataatacaggtgaaaacgccttctctgctgcaaggtgctataaaaatgccatgaatgtgtttacatacaatcccacacatttgaacagagctagtcagaattatttgttactatgtcatatatctaccagttgtaataacatggcatgaatttaaaggattctttttattttgcagtattgagaaaattttgagaaattagaaatgtatcggtaataactgatatagcttttgaagagaagaaaatactttattatttgcaggggttaggattattttcctggaaactttaagagaatcaacagaaaacattaaaaaaataaggagtataagaaagttcaataatctggaaatttcgataaaagtttttttccttgtcttggaaaacatgtagaaagaacacatacaacagaaaacaaaaacacacatttctatttctgaaaatgagaagacaagtttccaggtacctaaagactgttaaaagctgtcaagttcttgcacaatcttggtggaagaaacatggagagatgtggaaaatggagaggttatgagcaagggtgatacgattttatgcccagcaaaaatatttttcaaaactgaggataaaatgagttcactttcggacaaatcagaagtgcatatgttcactgccagcagattcatatcagaagaaacactaaaaggtgagtttcaggcaggagaaaaatgaaacctgatgaaagtttgtagatgcagcaaggagtgaggagtaattaaaagagtaaatatgtggtttaaatcaatattgactttattacacaataaatgtaaatgtcttatggattttaggatatgtagtggaaactaaaatatagtagattatattatactataataaatcaaagaagtaccttgtaatctctgaggtaactgctgaaaaagaatagaaggatgtataacttaagctaatagaggagaaaaaagaaacaatgggaaaaaaacaatcaatccaaatgaaggtcagatgggaaaaagaattgattgtacattaggacaaatggagagcaaatattaaattgatagctatatgccaatataaatcattaattatatcaaatggaaattttgactaaatgcttcaattaagataaaacagtgctagactaaataaaatacaatatacaaccatatggtgcttcaaaagagaaatacttgtaaagctatggaaacactgaaagtgatgaaaaaatatatattttaaatactaaccaaaagaaagccagcaaagctatatttatacacacaaaggagacattaaggcaatgccttaggagaactggagagatataatgataaaaagttcagttaagcagggaaatataataattctaaatctgtatgcagttaataacatagcctaaaaataaagaattgacaacataatatggaatagacaaattcacaatcatctttggagattttaacataccactctcaataattcatggaacaagcagatataatattggtaagaatatagacaatatgagaaatatgactaacaaacttgacctaattggtgtatatgggacattgtacccaacaacattctttgatcctaacacctttattcataatggccctaaactggaaagaactcaaatgtctatcaagaggtaagagaataaacaaattgtggcatattcattgctatgtggtaccttggaatacgactcagtgattaaaagaaattactgatgcatccaacaacatagatagctcccaaaagtattatgctaagttaaagaagccaggcagaaaagttatatactgtatgattttttttttttttttttttttttttgagacagagttttgctcttgtcacccagcctggagtgcagtggtgtgatcttggctcactgcaaactccgcctattgagttctagcgattctcctgcctcagcctcccaaggagctgggattacaggcgcctaccaccatgcccagcaaatttttgtatttttagtagggatggggttttgccatgttggccaggctagtcttgaaatcctgacctcaggtgatctgcctgccttggcctcccacagtgctggtattacaggcgtgagccaccgttactcacactgtatgatttaattatgaaattccagaaaacgaagcactatggtgataaaaaaaaaaaaaaaggcaaatcggtggttgccagaggctaggggtggggtgaaaggattgcctgcaaagtgaaatgaggagaatatcggagatgacaataataattttatcatgatcatttgattttacaacactgtatacatgtgtcaaaatttattgacttgtaacataaaattggtaaaatttatgtctgtaaattatatcacaataaaactaataaaaaagatagaaacatcttttaatattgatatggaaatatcttcaagatacattggtaaatgaaaaatgcacaatgcataaaatgtgcatagtatgtaccttttttggaaaacgtagcatgtgtcttatatacaaatttttctcattttattttttttctcagaatctttccacttccttttccactcctgtttcctgtctccttccttcctctcctgttttccttctatcaggttgtgtacactctcttctaggattgctggacttcatgttagctgcatgattccaccttgaaatcaaacctgctctcctggccatttcttctaccccttaatcccactatctaattcttcagctccaagaagccccgtctgatcatacctttgtataatgttgttgttggtttttttttttttttttttttttttgtggtgcttccatagcatacaagattgttcccaaacccttagtatgccccagaaagggctgcagaagcaggcaggaacttagtttttgtaccttcatttcttctcttgccttccaaacggcctgtgctttagtcacattaaaccatttcatttttccttgggtattatgtactttatgacctcagacgtttgcaaatacgtctacttaggccatttctactacctttcttttttcttttctttacttggcaaacaattaaactggacagaccagatcaaatgttaccttttctgtgaaaattcattttttttactcttcttctcctgtggtgccttagtatttgaaaatactttgcctttgtgaaattgacatatgattgttattctctaaaaaagtaaacattccagatagggataaagatgacctaaaaatcacgtagattacctctacttgcagctgtctgtatgtatagatacctttgtataaattttacagccacatacaaatgggatctttctgtgatgcactctgtcgtctatttttttttcactcactgttatatcacaggtacctttttctgttgacagaaaaagacttatgtattatttttaatggctgcatagcattctgttttgcatattatttcctgaactagtttcctatgaatgtgtgtttaagtcatttacagttgtttgcgttagtataaatgatgtcacaatgaatactccactgtgtttgaaaatatcctgatgaatgtccctgatggcattggattgtaattatctgtgtgcctttctttcctaccagactgttattagtttcctgagagcaaaaaaccattatttatcttgtaatctacagaaccctgcagagtgccagtagaagcttaatatatattgttgaaagaaagaaggaataaatgaatggatgtttatatagttgggtacacatgtttatcatcacacatgtcttcagtttttactcaacttttcattggcctaaaggcctgatatctcttaggcattattcaatcccctacttgttcctaatctctttttacagatgtcattaccactataaattcaatatatagctttaagaataaaaatctgtccaaaccatgactcccccgtagactatggtggtcactgaaacatattttattaattgcagaaaaaaataaatgcaaatatctggcactttttgcctgaccctaagcagacacgagttactaagactgagattgtcaattgcaagaaaaaaccacatggtatgtgtggtgcatactatttacagctgttgtccattatgagttctctggagtaccatttgctgctacaattgaatggtcttgtaagtttaacttaccaacatgactgcaaaattgtcttaaatcacagaggggaagagaggaaagccaactagaactggctaaaatactgcttatgtcttcatgagaatccatcgttgtccccatttgcttcttcaggatactagaacagcctgcaaggtcttgtggtgtattacaatacagcagattatcaacttgactctccaatggaaagagacacattgttgatgtctctctgttagagcttgcatttggcttattgattaatgtactgcgttgtactaggtatatcaggcaatggaagccaactggcccagacaatggaagtgttttgttagtgtcaaaaatttacaagagcttaagccattttttatttcttcttgctgggctgaaagcacttactattgttgtccaatatgctgcaaatgaacatagttcaaaaatcacaaagagagtgatgtggaattatagaaccgaaaataggatactggttgggtacaaattcatcaagcctctttatttcgaaacaagctttttattggcgtgccaacacagcttgctttggaaaaagcgaaaccaactgtgagcaaatgatatagtaggaaagttgacctcccgttaatttcagttgtgcctagctagctaactgtacatctccttctttccaacatttttttttagaaagtttcagttagtgagtcattagtcctatggtgcagaacacctaatctgctatggactgaatatgtatgtcctcccaaaattatatgttgaaatcctaattcccaaagtgatggtgtcagaaggtggaacctttggaagttgattaggtcatgagggtagtgccctcataaatgggattagtactttaagaaaagaggcttgcgggaactcagttgtcccttccacatgtgaagacacagtaaaaagaaagtcatctaagaaacagaaggcggggcctcaccaggcacagaatttgctggcaccgtaatcatagatttcttggtctccagaactgtaaaaaagaaatttcagttgtttataagccacacagtctatggtattctgctatggaagcccagaaaaagtaagacaaatccattgcccagttttttcagaaacttacataactcatctcatgttaaaaatggtgaggctggaatttgaaccctggaaatacggctcctaaagttgttctctaattcactatgctgtactgtccctgattgggtaaacatgtcatctataataatttcagaattcgttttataaagcacagcctttggcatatatttcttctgatgaaaatgcatcatctccctttttcttaagatagcggttctcaattgttcttttctaaaacacacatgtcaaatatcattctccctacaactatttcactcttttctccacaatctagaaagcacacacgaatgcatgtcattcaaggtaatattattataaggatgactttaaacctgatcttacattgagtttaacagggtgtagcaaaaacatgagtacagtggcctaaccaaatagtggtttactgttctcaaacatccagaagtaacgaagaagctggtgaaaatgtggtatagctgcttaaggaatttgccaagaaccctggctccctctacttttatagtcaccatctttagcatgtgactttgattctcaagttggctttctcatctgaaggtatcacatctatgtgcaaaactggaggaagaagaagggcgaaggacaagacacaaaaaccaagtaggcatttaccagatgaaactgtcccctttaattagttttccagaaggactcacactctagtaacacttaaatgtcactggacacaactgtgtcacatggccactcctacctacaaaaggatccatgaagctagtattttaatatggacaaattccttccccttcaaaaatcagggtcctggtaataagaaagaaagggagaaaggctactgggcaggtgaccggcagtttgtgccatgtatgtaatatcataagcacttgcacttttattggtaactgatgactctgcaatatactctgttacttatcacaggatatcagtgagacactgactctatggttgagaatgtctgatctacaggatgaagtccaaatccctaaacaaaatatataagaaaggatcttaccagtttaatattagcctactttttaaaatttatgttccatcatctctagccctttgcttgagccacacataacttgtcttcattttttaattcatcgacttttgcgccactggttttggcatatgtccctttctttgttcagaagaccctcctcaccgtctccatctggtaaataatacttattttgcaagctccaatgtgaataccatcacatctttggaaatggccttacctctctcagtcatatctattttggtgttttgtatacacctccattagctcacttgtaattattttctttcatatttgtcactactgacaaatgctatggcctcttagagaacaaggactataatttattcaactttttctacccagtgctcctgcagttcttggaatatgctcaagacacctgcttaagggaaaatatagctgagtgttacctccagtgtataggtgacctacaaggagctgaagtaacctgttttcaccgtagtcagtaaaaatgcactgatctacaccccttaaatctagacctcagtggattaatggctgtcagcagaaatacggaagagacagatagtctttaggttttattttttttttggtcttagtgatgataataacataattcagtaattttaaagtgttttctttatatcttccattgcctattctttagctctgttatcaaaagatattcaattttttctttctttgtgcacaatttgaaacacagtttgtatcttcaaaaaggctacggctttttagattctgtatgagtaagatcgtatcatgtttgtctttccgtgtgtgtcttatttcacttaacacaatgtcctccagactcatccatgttgctgaaaatgacagaattccatttttttatggttgaatagtattctattgtatctatgtgtgtgtgtatatataaaatcatatattcatatatatgtgtatatatatatatataaaatcatatattcatatatatgtgtatatatataaaatcatatacgtgtgtgtgtatatatatgtgtgtgtgtgtgtgtgtatatatatatatatatatacacacacacgtcagtaaatgaatcaaaacacattttccacctgagcccagacatggctttaaaatgcatttcagcactatgatactccagctatcttctataaacaaaggagggaagacattcctatctttccctcatcagcacattctccataaagactgttcatgtcaatacactacctgtaactgggcagagagtgttttcctgactccctttgcaaagtgaagcaagcattgtaactccaagattgagcttccagatatttaactcttttgtcaaatctctctcaaggactgggttcagggtcttacagtcatggaattccaaagatactgcttctgttacttgccttctatttctgctaaggaatgagagggaccatcccacccacagactttacgaatgaggagggaaagagctaacacatactgaatggcaggcaatatagtgagtgctttatatttacttctttttgttttttataacaaccacataaagtcagtattattgtccccattttatagataggagatagtgtgaaagaaattaattcatttgcctgagatcccagaggtagtgagagatgaagataatcaatctcagatttgtgacatctagcatcatgctattgaactctggagaattagttatttcttttgtgatcttgataaaatctgcttcttgggttcttttcataccatcaaatagttacatttttgatgacagccttgagctgtaccttcatactttcttgagtcttgcagaccacagaggaagatagaaaatgggtaaatgtagatcagatatgtgttaggagcaatccatctatttaaaacctcatgccaatcatgtgaaaatcagtttgtatcttcaaaaaggctacggttttttagattctgtatgagtaagatcgtatcccatgagaaaaagagaatacaagataaactgaaaacattgaaggaaacaaaattcaaaacctacaatggaaaatgtatttttaataaaaattagtatcaaagaagcaaaaaagaagtttagaaaactataaaatagagcaatattaaaatttgggtttaattttcttatgtccctttttctgcaggacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaagtatgtcaggcacctggctcagccaaacccacaattatgctaccacagtgacactgtcatttcaccaagtaggcgtgattggagaggcctcggtactctgtcgagaataaactcttggttttctgttttctgctacaaataacaacatactttccatacacactgatgtcagtctcatggtttctttgaatagaaaggtatagaattgacgcctaggcaggaggatcacttgagacttggaccagtctgggcaacacagtgagaccccacctctacaaaacaaattaattaaaaaataggaagctatagaatcacaggcaattaatagcagaggaagaatctagtttaacatttttcttttaaaaaggaggaaactggtgtccagggtaatcaaatgacttgtccaaatcacatggtgggttaatgataaagtcagggcccaaactgtgatttcttcagagtaagaccaatgcttttatttacttattaatatttactacagggaaatctttattctcaattagctctgataggacacagctataagaatggtgtccctctagctaaataaaatgtcagctgaaaaacagaagttgaggttgttcttctctttacctagcccttacagaactcttcgaaatatatgatgggaaagatggctcctgtgcctggtgagctctgttgaaatggaccacattctcagagtttgtgagctgaggcccagacatcagatgaggcacccaaagtcacacaggtggtgcatgagggtgacaggattaacatccacaaagaggtctttcaaactttgtgggcaaaggataaagccgccccttgccatggtaatagatgaataggaatggacattctatcccatgagaaaaagagaatacaagataaactgaaaacattgaaggaaaaaaaattcaaaacctacaatggaaaatgtatttttaataaaaattagtatcaaagaagcaaaaaagaagtttagaaaactataaaatagagcaatattaaaattgttaaatgaaagagacaaaatgagaattataaagaaatgctaaaagcacaaaaacttcaaagaaataaaatgaaaatgacttaaaataaataagaatgatgtaagaaagatgaaataattcaatttttaagaaacaatttaagtgttaaacagccaagaatagactagtttcaaaagataagcaccgaagatagataagttgaaaaggttaaaagtatgaagatgataaattacaaaaagatgaaaagcataaattccaaatgatgaaatatgttaaaccaggttaaaggaaagcaaataaaagctacagaccataaaaataaaatttcagtacacacacacacatacagaaaggaaagacacccatgtacccatgtgttccttacaggtgagctcctcccagcttagctgttgccagacttcattttatttacttttttatagagattatttgagggcagagaatgttgggcagagagcagggtttcttctctttctctgtggtgactgattggcctttaagcacatgggaaaactgggaggccaagttcttcactaagaaactcgatcagaccttggaaagaaattagccttctgagctctcaagctggaaaggccccaaagcagtgttcgctcctggtcaaacagaactcagccgactcttgctatgtgttcctttaatggcagagaacagctctgggacatcagtgaatggctcctccctgcttgagcagccaaagattttactagcaaactttctcagcctaaatggatggaaaacagttatgcaaggcatcttgagggacatgatcccattttgacattttctcatccaagttggctcttttctgaaatctctccttcgctggaattgtctgaggtccagtagagaatggaaagagccctggatctagagtcatatgattcgttgggaattctggcttttctcctgccctagtcagttttctcttctgttggaagaggaagacaacatgctccctgttgaccattctggaaaaggtctcagaaacccaaggcaatattcaagctcagggattaagtactgtagtttcttcaattttaaatgcttacaccaccaaaccaggggatttatccagatctttggtttaaaggttaatgtgatctcagtcactgagtatcctcctggcctggacacacattatttccagctcacagctggttgctttggattcccaaatggcaggccagcttctccttagtgacactggcatttatcatcattaccattatttattatgatatgactaaaattaccttttcatttatatagcatctttcatcatggagctcaaggcactttgtagatcacttggattacccaaacaattttggctgaaagggacttggaaatcatagtgttattctactgaaggaaaaatctacaggtcgtagcacatcattatgaaaaaacttgagactgcctgaatggataatgcctcatcataaaagagcttaaaagtctcagtgcctgacccttccttagaacatacgtaacacatggtttatctaatttctgcttgaactagttctgtaattgacattttatttcagggcatgcccactctgttgtgtatcatcaggtggatttgtgttttactgtgttttgatctttgtcctgtgagcttcacccattttaatcattcctcccttaggatatcccatggataaaatctaatccccctcatccgtgcctgaattttcccatgtgaagttctctccaaccttgatgcagttcacctaaatcttgtgtatatggtatttttttcgatgttctcatcttcactggttttctctgggtatattcttattaataggctcctttttgtgacgctgtggtcttttgtcctttgtaatgtattttaacagttttgggggaacaggttttttttttttggctacgtggataagttattttagtggtaatttctgggattttggtgcacccatcccccgagcagtgtacattgtacccaatgtgtagtcttttatccctcaccccccaactcttcccccacaagtccccaaagtccagtatatcattctcatgtctttgcatcctcatagcttagctcccacttacaaatgataacatatgatatttgattttccattcctgagttacttcacttagaataacagtctccaactccatccaagttgctgcaaaggccattatttcattccattttatgccatgctgatatatatatatatatgtatttctatatatctcacattttctttatccactcataggttgatggcacttaggttggttccatatctctgcaattgcgaattgtgctgctgtaaacatgtgtgttcaagtgactttcatataatgacttttcctttgggtagatccccagtagtgggattactggattgaatggtagttctacttttagttctttaaggaatctccatactgttcttcatagtgattgtacgagcttacattcccaccagcagtgtaaaagtggtctctttgcacatctacgctaacatctattacattttgattttttaattatgacaattgttgcagaagtaaggtggtatctcattgtggttttaatttgcatttcctttataattagtgaagttgagcatttttttcatatgtttgttggctacttgtatatcttttgagaactgtctattcgtgtcctttgaccagtttttgatgggatttttttttcttgctaatttgtttgaattccttgtagattttagatattagtccttcgttgcatgcatagtttgcaaagatttttctcccactctgtgggttgtctgtttactctgctgattatttcttttgctgtgcaggagctttttagtttaattaggtctctttttttgttgttgttgttgcatttgcttttggattcttagtcctgaattctttgcctaagccaatgcctagaagagttgttacaatgttatcttctggaatttttatggcttcaggtcttagatttaagtctttgatccatcttgagttgatttttatataaggtgaaagatgaggatctagtttccttcttctacatgtggcttgccagttatcccagcaccatttattgaatagcatgtccttttcccactttatgttttgtatgctttgtcaaagatcacttggctgttaagtattggctttatttctggatattctattttgttccattggtctacatgcctatttttatgctagcaccgtgctgttttggtaactatagccttgtagtacaattgaagtcgggtaatgtgatgcctccagatttgttctttttgcttagtattgctttggttatgtggcctctttttttggtttcatatgagttttaggattgttttttctagttctttgaagaatgatgatggtattttaatgggaattacattgagtctgtagactgcttttggcagcatggttattttcacaatattgactctacctgtccatgagcatgggatgtgtttccatttgtttgtgtcacctgtgattttttttcagcagtgttttgttttcctagtagagatattttacctccttggttaagtgtatttctaggttatttatttatttatttatttatttatttttacagctgttgcaaaagtgactgagttcttgatttgattctcagcttagttactgttagtgtatagcagtgtgtgtacattgattttgtatcctgaaactttactgaattcattgattagatgtaggagctctttggatgagtctttagggttttctaggtatataatcatatcactggcaaacagtgacagtttgacttcctatttacagatttggatgccctttatttcttgtctgattgctgtggctaggacttcaagtactatgttgaatagaagtgattaatgtgggcattcttagtaggcttcttaaaggtgaaagaaatgtcctgtgtgttgtctgatcagtaaagagacaatccttgcataaagattagagaaccaaaacctgaacttggcacttagcctacaaggctttacttctctctcaccaataaaaatgggccttatggagcttgcaataatgaataaaagcagacccgtttccttttgtggtgatggtgatggagcttctgagagtgcctgatagcttttgataagagtgtccagtgaaataaaggcatgatttcccagcaaaatttagggagtcctgccaagccaaggatctcttagcaacacatgtctgaacagggaaagaaaatacaaagatggaaggttatgttaagttcaaaaacaaacaaacaaacaaacattttgtcatctttctggcctggtagtttgtgttgaattgggctgagttctaagtaaatcaggaggactgatccagcggtttcttgacacttaaaaatcttcccaaggtggggtaaaaatagaatgggcagtcaacagattttcttagagcagaagtgataattggtagctggattagagtgggaagtggggagaagacaggtgattcctgaactgcattaaaggtagacatgatgtataaatgagcacggggtgagggagaggataagtcaagcatgattcccaatctttttatcttggttgttgggtggtagtaacaaaataatttttataaagtcaacacacagcctaacattttatttacaggagaaccagggcatattgattcttagagtatatacaactctaaaaacttgattatcttctttcaaggccattgtggaacagaagcaaacagcaataaagagcaaagactccactataagtaaatacaccaaggtattaaaacataatagttgaatgcactagaggaaacaaatcaagctataaaaatcagatacaaaatcttgaccattttaacaatctgggaccatttaaagttagtgccagtagtgtttactccactgtgggttgtgaagactttacaataagagcactcacagaatccatctaaaaaattattcagcaccttttatgggccaagaaagaagctagttcctttacatatattgtcttacttaatcatcactatagcccaacaaatgtaggtgttctatgcaatttctagataagaaaagttgagcacacaggcgttcagttttgagtgcagtttaaacagctggtgttacagagccaggaactcaagtctatcccacattactttgctgtagatatttaagggagttagaatgtaagaaccttaacatgttcttgcagggcagattcttgtatattatttagtcccagtcattcaaatgataaggaaactgagaccaaagaggtaagtgagttatccacaattacatagctagttcaacatggaactggcataagaaattgtctagatattgaaaacacacacacacacatccatgcccaaggttatatgactagcttgtgggagagctaacttcaaatcctttgttcattttggtctatcaggtcttcccaaccttggatagagatataaatagagtcttagccccatcagctgcttggttctgaaattcatcttgctgactcagatcttcatatccagggtgcctgggagaagccatggcgcagccttgcccagatttctgctattcttgcccgggatgaatgatttggttcatcctcacttcctagctgggcttgatcctggacactctaccttgactttccagctttctctactagagaatgctgtgtccttccctgtcactgccagcttttggctgcaaacacctcagctgactgtgaatatttattgtcatgggacttctgttctatggctcactttcactcaactcgccaggatcaccaggagcttagactgtctcctctgggctgggccaggccttttccttcccattttgaactcagctctacttttgaatgtatttaaagtcctttggtataatgacatgcagcagtggctctcagacttttggatttcacagatctgttgaatttaaataaacagaggactgattagtaagtatgtcatttttcatttgaacaagtaagaatggaagatactctctgagatcccaaacaattgactggggaaagtttcagtctcatttgtttcttgagctgctgccttttctacatgggattatgcagataatctgggagatgtgatgctgggcctgtagatcacggcaatgagcatacttgccatgttcactataagccatgctgctggtacccatgaaggcttctttgtggacaggaagaagtgtgtagtcaataagtgtgttagttattcccactgttaatcatccttttccaggaacagggaaaattctggaagaggaaaatgtacctgaaaaatgggcccttaagggaaagaggcaatgctcttgagctttaaattgggaatactcaggtctaaccagggggtccccgtaggtcatagaggaatgatggcctctgccatatgggggaggccagaggagacaagtggcctcttgagaatgagaacagctatactaataatcagttttaatttttttgagtagttatcttttgctatataattgactatctaagtgttaatcagtcttctagtcttgtttcagctatgctactgggctttaaagaaagtgcctatgcctggccgggcgcggtggctcatgcctgtaatcccagcactttgggaggccgaggcaggcagatcacgaggtcaggagattgagaccatcctggctaacacagtgaaaccccgtctctattaaaaaataccaaaaaaaaattagccagctgtggtggtgggtacctgtagtcccagctacttgggagggtgagacaggagaatggcatgaacctgggaggcggagcttgcaagtgagccaagatcacaccagcctgggcaacagagtgagactctatctcaaaaaaacaaaaaagcaaaaaaacaacaacaaaaaagaaagtgcctatgcctaagattggttaaggggaaaagtggctctcatacgtaacgaaattcctaagggaacagtggaaatagtacaatggctaatacattttaagagatgtactcagtaaaatgagaacatttaagaaaataaaatagatttgttttctaattataaaaatgatacatgatacagccaagataataggtgtttcaaaaataagacttaatataaggaattagtacaaatctaatacaaggttcgcgcaagtggtagaagtctaagttcaaaaggagatgctaaaaaaaaaaaagattaagaactgtagaggcagctaccacctgtaataatggaggaagcaaatgccagaggaggagttaccagaacctagcaggttgaggggctccatgaggctggtgtttggaactctgtgaagggagactgatctggctagggcttcagtgcacagcaggcacagcctagagggtgaaggagtctagagtggcctgtatccaaatagtaaaggaaccatttggttcttcctgctgctgatgcctttgatggagtgcagcaatgctggtactatgggagctgaaggagtagggattgacatatttgattgcagctgctctggtcttcttaactggaactgggaaacagaaagagtgtgtttctttctcaacttgccttcctatctttctctagggcttctcattggcagaacctactgtcaactgtcaagggcatctgagcactgtagtctgcagagttttaacaacaagtgaaaataagtgcaaagtatctatttaccgagtgctcaacatgccgtagtatggttcttagcaccctgtctatgtgacttcattgttttcaaaaaacaaaatgattttattgtttccagtgggaaaaaatgcacatcattattataaacaattcaatatgtatagagaaagcttaaggaagaaatttaaaggcacctaaattcaggactattgcattgtataattccaaagggcatcatttacattataatctattataattacatagtgcctctggaattttgtaacgtagaggctcttcctgaatcaagctgcccagagaaaaacattattagcaagttgaaggagatattttagccatttgtctataaattgacagctttaggtatatcagctatatctttaagtatatttctattttaactttcataagataatatattttgtagtataatttataaactaaccacatcttcctatggcaaaaatacaaattaaatgatcagttttaaaaataaccatctttcagtattgatggggccataattaatgtaaacaattcttcattataaactgtagaaagatgaatattttgtttattcttagcattttttctggttattttcttaagataaatttttaaagtagtcaattgagtcagatgttatacatattttatatttgatacatattgttgccagattaccctccttagaaaattcacagattatattccttgtactaatggatagaagtgactggtcctcatatgcttgttaacactacacattatcaaccttttcattttctgtcaatctgattggataaacatgattttattttcattttttatatttataacttctaattattacaactacctgaaaaagtaaactgtttaatttcattttgcagaccgaaaaatgaaactgaggcaaaaggagattgagtgacatactcaaggtcagtcccgtgtctaataagtttcagagtcagaaattaaactcaggttcatctgtttgcaaagctcttgttcttttcactagggttatacagccccactgtgtcaaagcttctagacaatcatcctggtgtctttcctcttgagtgtttccagcatagaacttgggaagtggtaagtgcccaatatatgtcttgtaagtctagttctgagtgtacctaatctttctaaagtctcttaaaatgtggccctccaggtaaggtcattccagaacagaaaggcttctaaaatgttttactataggtcagataggaaggtaaagtttgtgtactactcattgaaggtatgatttttgttgaacttgtgcgcataacaatcacttagcatttttaattccctttttctccttttagtcatcatttactgtcttgaaagaattactgaagccatactggggagccttgttttatgtctgggcattctccaacaggctaaggtttaataagcatggggtctgtggatccttccaagctggatttatgatcgtgggactcttggatcatgtgggggaatgattccctttcccatgattcgctggtccacatttggcttctgaaatgcacattccctgtatgcctatgggtgtgagttttgcagtgctcacccacaaagctagggcagaggaccaggactcctctgcaggagggagaaggagcgacaggaagaagcagcgcagaccagcaaaggcagagggcaactggctgtcacatggtcagctcccagcaggcgtttctgtctctttctttctttccctgtctctatctctgtttctcaatctctctctttctgtaactcttcaaggcattgcatcccctctctgaaagcttacatgatcacaagctgaagaacctgtaggagaaagttctctatgttctgtggcctctgggaaatgaataattctattgatattctctgtagaaatgatgctaatgacaagatgggggagtaaaattcccctgactcccttgtgaattctcattccaaggtttcagctccaaacttctcctttcaggcacaggctagggcaattcaaagctcctgctgtaacatctctctgtgaaatgtttgctatccgaaaatcataatctcttcgcagttaaagcttaacctctaccagtcatctgttccttccacatggaactcaactgctcttcctgggagctgacaaaggagcttaaacttgcaatcatgtttaattcctgagtttcattcgtcacattttaatttagattgctttgctattttgtactgtttgaaacagagcagaattattggtggatggaaatttttgcttcatttggtttttagaaaaatttaagaattttgagacatgaagcagaggttgagtgtttggatgaaaatgtcaatctgggttctggttctaccctgtttatccatctctgtgtcaagatgctctaaggggagatgggcaaaagggtttttaatcttcctttgcattactttccttatatttaaaaatggggaaaattgttattctgattcagaaggggtctgaggaactacaatttttcctcactttctcctgccctcactggaaaaaaagtaggggtggaggtctcagccattttgaatgtgaagatattctcctagacaaaaaaacaaaaaatgaacattataggaatagtttaatctcacagcttttgtttacaactttataaaatgaaagacagacacatatttaaattttaaaaaatatgcagaagtaactgttttctgccttaaattcctgcctggcaaatgcctgtcagtaattcccaaatcatggtctgtagagaatttgcagggcatccgcaatgcgtcttcagacaagtggaaggaggtggagagacccatgaagaacatggcacttggtgcaaccgtccaaacctctgtccataaaccacagacatagtatggactcagacagcactgagggccctggttctagagggcaacacactcaatctttctgatgaacttgttcgtagagatcaaaatggaaattatttgctctgggaactcttaaggtcctgctgctaagtcatttgcatagtgttaaatgatgcatagtgctggggctggattctgggagtgtgttcccaagggcttcctcacatacaccccattcccaccatcgcctgcatacacagaaggcgtcaggagcttgaggactccatttgccttcctcagacattgccattttgaataaatattactatttattatccccaaatttagagttattaattatatcagcataaacctaatttatgccatcataaacagtgataataaatgctgccaaattctaatacccagctcttgccaactgtgcctgtagttgatgggtttccccccctcacttcccagaagcattaaattaaaaatgattcagtgttgcagaatcattgatcaagttggggctgaggctcctcaggaaatgcacttgttttgttcaatgctttgctctttcattggccgggcagcttctgatgtctgtccgcattccaatgtttctcctttccttcctcccctcctctgatcctcctataggaggaagaaatccgtgcagggatgcagggatagagggaggtagatgagcatctattatttcattctaaatttcccctttagacatctctcttcttagcatccccacttctaactctttatttcaacataaacttagaaatctttataaagcaaacccttgggtataatatagataagttatttctcaatttctaaatacatctatcatgtatttagggatggatgtgatacatggcttcctaaaatacatgaaagcctataatgggaaaataggaagcatagctctgagaacccccaccaaaactgaggaagctttttcttttggtagttactctcaggggtgctctgattttgcagaggaagaggaaaagcctgtccctgtgttatcagaactgtaatgcaatctcactgcttttctcaaggagaaacagtttttacttttccttcattctccctggcttttactttgttttcatcagtgatgattgtggtggtgatgtagtataaaaaaattccaacaagacagtcagaagaagacccactttaggtcaaagttagcttctttatagctgtgtggctttggacaatttacttaacttctctactcctgtttgctccactttttaagggagtagtaagccctaaccactgcacctcacttgattaatatcacaatcaagtaccatagtacttcaaaactattaagtactgaacaaaggtaatggttccttttattgtgttctgatgcctaaatttcagtggtagggcatctatgttcttctcaatggtagggccaaacagtcttaataatctttttcctgcttttcattttttagttttgcaaagagatccaggataagccatggcaataggatagaaattctaaattttgcagaggaagagacaaggtcaaatgtagatatatatatatatatatatatatatatatatataatatactattttatatataaaatatataatatatattataatatatattatataatattatatataatatatgttatataatatatataacatatattatatatatatagagagagatcttgttaaagttttggttatccttttgattttaaaattatggggcaagtatagaactgaataggttgtacaaaaaattcagcaacagagaaagcttggaactgagtagttcagctaatgccttttttcctcatgcttactcatcaaatagatttaactggcaccttggaatggagaaaaaccctggcttcttgccttcagaagccagcctatcatcagcctccatcaaggtatctccaagagcttttcagggtgtctgtaatgagcagcatctgtggtgcatggagtctgtcttccccagccgggggactgcctccctggggtgggtacccaagcctcaagatcacagaagcccagtttcctagaaaagtgcacctatcaggaaccagaaggaattgcacctcgaaggctggcattggaaaattgcccgagagccttctgctctctgttctggatcactctgcctggcagtctggagtttctaagcaggaaagtcaaaggcagcatatatactttgataatgcagatccacctccccaccgcgatttacaggttgtcttttccttggctattcatctctctgagccacatagcccttttgaattattagccttactccttcattgcccaccttccttcttgcaaacatgctcccatacattttcactccacagaaaatgctttcttctctatttacagcttctttctgccccctacccttccctctggtccgataactaatggccaaggagataaataagagacataactctttttggccattttttttgtcattactctgcataataacaaggaaacaaatcttattactaaagtaattacaataaataaaaaataactgagagtggagcttaaagaaggggacatagcagggtagtgattacagcaggattttaaaattttaatttactagtgccagtctctgttactctgttcataccctgcttaggagattgtgtctaattagggattggttgttattggtctttgaaagcacccactcctagctgacttatccctaggtctttaaaggagacatttggcccaaggaatcccttgaaaaatctctttgtcagcagctcaatgttggaaaatagcagcatttagcatgttaagtttcatcatcatcaaagcttgggaattgcaaataattacttggcatttttccctctgtagataacattctcttaactagtctatacagacatgcattcaccctaacatccgtggatcaccaagtcgaggacacagtacacccttttgtagaatacactggtgctgaccaatcttagagttagaccatttttctttatagccaatctaattttatccaaaagcaatttatgtcctttgtttccacagaggaagtgtggaatgtttatttttcttcattaatcatgactattatcctatttctgatagtcatctttccaagtccttttggtatttgagttgcttctctttctttttgaacctaaatcttgtatgttcagtgtttagtcctgatacacagtgttttaactataattgtcagtgtttggtttccttaaccttctccaagttgctcttgagtgtggaaggatgaggtgcagcatagtggctttcccatgcatcttagcatctttctacaacaccatccctaaacttcaagtgcatttattaattcctgtgaccatgtgcccttctaagttgctctaaacaagtggtcttagtcgtctacacatttgaaatatagggcaaatacaaaatttagacacagttactacaacacttcttccctaaaccactgccatccccaccatctctactatcaccaccaccatcagtgacattacaagaaaatggcaaatattgaatgagcatttaacacatgcttgacaatgccaagtactttacatatattatcttttaattctcacacaaccctctgtggtaaatattaataatatcttgactttactaatgaaaaaagtaatattttaagagcaaaataagtgtcccaggccattcagaacacagatagtatttggataaaaagaatattcaattcagtttctttctttttttattttgattctagatcctgcccactaacaactacattatacatggaatcagaagttatagaattctgtaatgttagaggtgaaagacatcttacatttcaacaaaccggccccaccctttctttatagaagagaaaaataaaagatgctcagtaaggtaacagtaggttcttaaatctccacaatattagagttgaatttgaagtccaggcctaaaactttccccactgaatctccattacatgcaaggataacatatttgcaatctagccagacatttatgtaaactattatgcataatattatgacatttgggaatgcaaagcaaagataagttattcattaagacagataacgcaggattgagtggtagttctatttttagttctttgtgaaatctgcatgctgtcttccatagggataataatttacattcctatcaacagtctataagtggtcccttttctctgtttcctcaccaacatctgttattttttaatctttttaatagtagccattctgaatggtataagatattatctcatggtggttttaatttacatttttctgataattagtggtgttgggtattttttaggtgcttgtgggacatttgtatatcttcttttgaaaaatgtctattcataccctttgcccactttttaatggggttatttatttattttttgttgagttgtttgtgttccttgtaaattctggatattagtcccttttcggatggatagtttgcaaatattttttcccattctgcacgttgtctgtccactctgttgattatttcttttgctgtggagaagctttctggtttaattttcccatttacaattcacagtagcaaagatgtggaatcaacctaactgtccatcaatggatgattgaataaataaaatgtggtataagtacacaatggaatactattcagccatataaaagaatgaaatcatgttatttgctgcaacattaatggaactggaggccattatcttaagtgaaaaaaactcagaaatggaaagacaaatactgtatgttctcacttataagtgggagctaaataatgtatacacatgaacatagagtatggaatgaaagacactggagactcaaaaggatagcgaggtgaggaggaggtgggtgatgagaaattacttaatgagtacactgtacattattcaggtgataggtatactagaaacccagactttatcattatgcaatatattcatgtaaccaaattgcacttgtaccccttaaatttatattaaaaagagagaatgcaaagagttctgtgtagagatggtcaaaacatcacaaatattttagcctgtctaatatagcttcccagaggtagttggatgtctaagtgtgctttaaaaggggaggcagaatacccctggaagaagagtgatagtatctccagaccagcattttcttaatggcttctgcaggacgctagcagattggtgctaatagatgtttcacacaagagggtgctatggcttgaaaagttcaaacaattttgggtaaacaaattttcttttaattgtagaaatgttcagtgccattaaaatattaacatgcatggagactctccaagatgggaaaaaatatatgccatttcctgaagttatttgaacagggtcacatttgttgaagtacacctaaactatctagaggaacattaacgatcactcaacttgggcaatgtttccccaggcttttaactgagatgcagacataaaattaagcctacttagaagaagcacattagcatcgtggctaagaacacttagaatggagctgtattgcttgggtttgccatttactagctgtgtgaccttggacaagaaacttgtcataggttgggttatttatgatacagtctccaagatggagacttgctgtaggaaattagttgtgttgagttcttgggaataacacctatgagagcgtaagggaagctggattgggcatagagtacagttgaattgtgatgcatttgctattacgaaggcctcagatgatcagtgggtaccactaactgctgggatgcctctttacccaatggcctttcagtgtctggaattaaggcaagtggactgagcctttcctttgtactccccaccaatgatccgttcttgaatatgagcttcctgtagggagggtatacaaccccagggaaagaagatccctttggctgagggcaattcctaggggaagtactcagttgtgagcttcagcagccagtagcagctgaggaatgaattccttggtcctaacggtactctgagggatacaccacagtatctgctgtgcttcagtttcctcatctgtaaaacggggataatagcaagtaatgacctttttaataaggccattatgagttaagtgagttactatataatatgcctgatacttaatagtgttcttatacatgttaaagtaaacaacacttataagaacagttattatactttaacacctataaaatcactattaaataaactaaatagtgtatttagcatgaagccttattaagctcttttgatggcttaatcatattgctaactcatttttagttcattgtcaaataaaacatctaagattttttaatattaattgtcattaacctgaatgtttcctggtatgtcactgtgtagttgatctaaatggatcaagtcttgaacccatgcttatcccaatttcatccaattagattccattcttctgagaccactttggatctttaatctgtcatccattttgtacactaagttgtgctcttataaatgttatgattattcacatttatagttaagacaatgaaaactggaaaaacaaagagaatatatccttcattcctagtgtattaaaaacaagtgcctatatgtcatagtattttcacatgacttttttttcacagctttttcttagccttggacaaagaggctattactgcattttctgctgtgttctttacctaataatgtagatatcactgttataagaatggcccactctttcagaaggtaccccctcagacagttcatgtatttcataaacaaacaaaccaacaaacaaaattcagtccaggccaagatgtaatttgagtagagatgactaaatattgactcgtttctaagaagtggattgtgattttgacatgacctaaagggaactgtattcatggaaaagatggcctattccaatataatgtcaagagatttgatgctagcatagctgagatcaatttttcttttatttttgtaaatgcggtgttaaatgaaaatgtccaaagcttgggctgtgctttccaatgtcagggcaaaaaatttgagtgtttatgagtcctgatcaggctgggcttctctctagaaggggagactgcagcacattagtgcctgtcatttgtgatagtaactgtggaaactcagccagcaagactcctttcagcagtaatcagggccattgatgtccatctgatctcaggtggggaacacttttttataaaaaaaaaatgtaattcaatatctagctattaatctagccatcttggcagtgcattattgagtgttctaattcagtggatttggccactgagagactcagccataatgcatgtaatgtaacggatatcatctgaaaagcaattgttctccttggctaggttatttaaagccattgaataacataaaatagattatatatccataatagtattgagaatcattttgttcaacctagtttttcattgtatggaaaaagaaataggcttagcaattcgatgctatgtaaaaagtttacccagtttcctggcatagataagatcaagtcaaaagacaatggactcttccattccagtgatatgcaatttctcttggacaaagatcttatccctattattccacagaggaagacagtgtgagctctacatgaatatatttctgtgacttgatcatacaaccatggaatcttagagaacttaacgtctagttcagtttttcaacttgcacttaaaattcctttatagcattcatcacatgtggccaaatagcctgtgctctagcatgtctgtagtgtgtgaacttatttcctctcatgtgaacttatttcattttcgatagtcctcttagaaagtcatttcttaaaccatgttaatatatttcctctcaaagcttctatccttcatgccacatacagtaagttgaattactcttctttggactttcacacaactgaagactaccctcatatcacctctatatgttttcctttctccacagtaagaatctgtagtttcttcaatcacttgtcttgggatgtatttttggatctctccatcattccgattgttatctgaattacctcactcattaatgcaataaatgttcattgaacatatcctaagtaagaaacattggtaaacctgtggatgtaacattgaacagagcaagctgtttacagtagagaggtggaaacagacaattcaaaatagtatcatacagtgttagacatcatctgatggctgttagccatacagatgcccagagaaaggggacctaatttggtcctgaggtctgggacaacttcttgtagcatctacattgagagctgaaggaagggttagccagcggcaaagagtgtgtgtgcagtagaagcagggaggtgtcagagcatgctggtctacatgagagactggcatgttcagagcccaggaatatctaagtttttattatgatggaattcccggatgaccaccattattattctgaaaaccaaattgctattcatgaagcctgaagcatgaagacttaagctcttttgatggcctaatcctattgctaactcattttcagcttattgtcaaataaagcctcgaagttattttttatattaattgccattaacctgaaagtatcttgctgtatcactctatagttgatctagatggatcaagtcttgaatcacacttatcccagtttcatccaattagattccattctttggagaccactttggatcttgaatctgctatccatttcatttggctttctactaatttacatggaaacttcagagctgacaagaatttcttttatctttttatcatgtcattgatacatttgttgaactggagagaaccaaggacagtgtactagaagacatatcaccaaaggcacaggtccatttagttatgatcattcaaccactttctaatctattttagtgctgccattgaacccatctttctttatataacttgcaaggatatcttgagagacttttgcaaattcctcactgaaggcctgttaagctctgtctccttatctaataacctgtcaaagtgtgaaacaaagttgggctggcacagctggaacaattcccaaaattgttcttggttacaggtgctggtttttatgagttctacttcctttcctaagagaccccatatttccctgttaatatgctccagaattttgctgaagatcagtgtcaagctcactggtttcatctgccattttctcttttttcaaaaatggagacatatttgctcatccttagtcttgataatttcccatagattactgacattgtcttaagctaagggtgggctaagccactgcctttgaagagtgaagaggagaccccagctcctgacttaggatgattcagacttcccacaggcacctctcataattgagaacttgcagcacttagtcttacctgtcctcagaatagatcattcatcatgcttgtcgggatgatttagtctgggggtgtgaaactgcaattcctttgaccttggttcactgaactgacatgttacatatgggcccaaatcattgtaacttcaggtgttttaatctagaaaatgctttatgacactacattgttttacttccattgacttaatgctctgtagtactaaccaagttccctcttggatatgagtagatcatagatggcaaagactgaacattttttgatagtgtgatatgctatcaaagatacatgactaagatatgtcctgcatatcttggcacttttgtccacatgtggtaagctttcaggggttaaacggcaaaatttggggggtggctggcaagatggctgaataggaacagctccggtctatagctcctaccgagatcaacacagaaggcaagtgatttctgcatttccaaccgaggtacctagctcatcttcatctcattgggactggttagaaagtgggtgcagcccatggagggtgagcagaagcagggtgttgcctcacctgggaagttcaagaggtcaggaaactccctcgtagccaagggaagccgtgaggcactgtgccatgaggaatgatgcattatggcccagatactatgcttttcccacagtctttgcaaccggcagaccaggagaatcccttgggtgcctacaccaccaaggccctgggtttcaagcacaaaactgggtggctgtttgggcagacactaagctagctgcaggagtttttttttttttcataccaaagtggtgcaggaatgccagcaagacagaaccattcactcccctggaaaagaggctgaagccagggagccaagtggcctagctcagtggatcccactcccatggagcctagcaagctaagattcactggcttgaaattctcgctgccagcacagcagtctgaagtcgacctgggatgctctagctttgttgggggaggggtgtccgccattactgagactggagtaggcagttttcccctcacagtgtaaacaaagccgcccagaagttaggactgggcagagccccctatagctcagcaaagctgctgtagccagactgcctctctagattcctcctctctgggcagggtatctctgaaagaaaggcagcagctccagtcaggggcttataaataaaactcccatctccctgggacagagcacctgggggaaggggtggctgtgggcacagcttcagcagacttaaaacattcctgcctgctggctctgaagagagcagtggatctcccaatacagcactagatttctactaaggaacagactacctcttcaagtgggtccctgacttgtgtgcctcctgacagggagacatctcctagcaggggtcgacagacacctcacacaggagagcttcggctggcatccagtgagtgcccttctaggatgaagcttccagaggaaggaacaggcagcaatctttgctgttctgcagcctctgctggtgacacctaggcaaacagcatctggagtgtacctccagcaaactcaagcagacctgcagcagaggggcctgactgttagaaggaacactaacaatcagaaaggaatagcatcaaaatcaacaaagagaacatccacacagaaaccccatctgaaggtcaccaacatcaaagaccaaggtagataaatgcacaaagatgaggaaaaatgtccaaaaatgctgaaaattccaaaaaccagaatgcctcttctccaaaacctcacaactcctcaccagcaagggaacaaaactggatggagaatgggtttgacgaattaacagaaggaggcttcagaaggtggttaatcacaaactcctctgagctaaaggagcatattctaacccaatgcaaggaagctaagaaccttgaaaaaagttagaggaattgctaactagaataactttagagaagaatataaatgacctgatggagctgaaaaacacagcaggagaacttcatgaagcatgcacaagtatcaatagccaaatcaatcaagtgaaagaaaggatatcagagtttgaagatcaacttaatgaaataaagtgtgaagatgtgattagagaaaaaagaatgaaaaggagtgaacaaatcctccaagaaatatgggactatgtgaaaagatcaaatctatgtttgattggtgtacctgaaagtgacggggagaatggaaccaagttggaaaacactcttcaggatattatccgggaaaacttccccaacctagcaaaacaggccaacattccaattcaggaaatacagtgaacaatacaaacagcaacttcatcaagaagagcaaccctaagacacataaccgtcagattcaccaaggctgaaatgaaggaaaaaatgttaagggcagccagagagaaagggcgggttacccataaagggaaaccatcaggataacagcatatctctctatggaaaccctacaagccagaagagagtggggccaatattcaacattcttaaagaaaaaaaactcagaatttcatatccagccaaactaagattcataagtgaaggagaataaaatcctttacaaacaagcaaatgctgagatattttgtcatcaccaggcctaccatgcaagagcttctgaaggaagtactaaatatggaaaggaaaaaccagtaccagccactgcaaaaacataccaaaaggtaaagaacattgacactatgaagaaactgcaccaactaatgggaaaaataaccagctagcatcatgacaggatcaaattcacacataacaatattaaccttaaatgtaaatgggctaaatgccccaattaaaagacaaagactggcaaattggataaagagtcaagaccaatcggtgtgctgtattcaggagacccatctcacatgcaaagacacacataggctcaaaatacagggatggaggaagatttagcaagcaaatagaaaggaaaaaaagcaggggttgcaatcctcatctctgataaaatagactttaaaccaacaaagatttaaaaagacaaagaagggccttacataatgggaaagggatcaatgcaacaagaagagctaactgtcttaaatttatatgcacccaatacaggaacacccagattcataaagcatgttcttagagacctacaaagagacttagactcccacacaataatagtgggaggctttaacaccccactgtcaatattagatcaacgagacagaaaattaacaaggatattcaggacttgaactaagctctagaccaagtggacctaatagacatctacagaactctcgacctcaaatcaacagaatatacattcttctcagcactgcatagcacttaatcaaaaattgaccacataattggaagtaaaacactctgcagcaaacgcaaaagaatggaaatcataacaaacagtctctcagaccaaagtgcaatcaaattagatctcgggattaagaaactcactcaaaactgcacgactacatggaaactgaacaacctgctcctgaatgactactgggtaaataacaaaagtaaggcagaaataaagaaattctctgaaaccagtgagaacaaagacacaacttaccacaatctctgagacacagctaaagcagcgtttagagggaaatttatagcactaaatgcccacaggagaaagtgggaaagatctaaaatcgacaagctaacatcataattaaggaactagagaagcaagagcaaacaaattcaaaagctagcagaaaacgagaaaatacttagagcagaacggaaggagatagagacatgaaaaacccttcaaaaaaatcaatgaatccaggagctgattttttttgaaaagattaacaaaatagatagaccactagccagactaataaaaaataaaagagagaagaatcaaatagacataataaaaaatgataaaggggagatcaccactgatcccacagaaatacaaactaccatcagataataccataaatacctctatgcaaataaactagaaaatctagaagaaatggatacattcctggacacatacacactcccaagattaaaccaggaagaagtcgaatagactaataagaagttctgaaattgaggcagtacttgatagcttaccaaccaaaaacagtccaggactggacagattcacagccgaattctaccagagacacaaagaggagctggtatcatttcttctgaaactatctcaaacaatagaaaaagagggactcctccctaactcattttatgaggccagcatcatcctgataccaaaacctggcagagacacaacagaaaagaaaagttcaggccaatatccctgatgaatatcaatgtgaaaatcctcaataaaacactggcaaactgaatctagcagcacatcaaaaagcttatccaccacgataaagtcaccttcatccatgggatgcaacatatgcaaatcaataaacataatccatcacagaaacagaaccaatgacaaaaaccacatgattatctcagtagatgcagaaaaagccttcaataaaattcaacaacctttcatgcaaaaaactctcaataaactaggtgctgatggaacgtatctctatcatactgaatagcaaaagctggaagcattccctttgaaaaccagcactagacaaggatgtcctcttttaccactcctattcaacatagtatttgaagttctggcccgggtaatcatgcaagagaaagaaataaagggtattcagataggaagagaggaagtcaaattgtctctgtttgcagatgacatgattgtatatatagaaaacccattgtcgcaaccccaaatctccttaagctgataagcaacttcagcaaagtctccgtatacaaaatcaatgtgtgaaaatcacaaacattcctatacaccaataacagacagagagccaaatcataagtgaactcccattcccaattgctacaaagataataaaatacctagcaatacaacttacaagggatgtgaaggatctcttcaaggagagctacaaaccactgctcaaggaaataagagaggatataaacaaatggaaaaacaatccatgttcatggatagaaagaaccaatatagagaaaatggacatactgcccaaagtaatttatagattgaatgctaaccccatcaagctaccattgactttcttcacagaattagaaaatcaactttaaatttcatatggaacaaaaaacaagcccatatagccaagacaatcataagcaaaaagaacaaagctggaggcatcatgctacctgacttcaatctatactacaaggctacagtaaccaaaacagcatggtaatggtactggtaccaaagcagatacatagaccaatggaacagaacagaggcctcagaaataatgccatacttctacaaccatcttatctttgacaaacctcacaaaaacaagcaatggggaaaggatttcctatttaataaatggcattgagaaaactagctagccatatgtagaaaactgaaactggacctcttccttacaccttatacaaaaattaactcaaggtggattaaagacttaaacataagacctaaaaccataaaaaccctagaagaaaacctaggcaataccattcaggacataggcatgggcaaagactttgtgactaaaacaccaaaagcaatggcaacaaaagccaaaattgacaaatgggatctaattaaactaaagagcttctgcccagcaaaagaaactatcatcagagtgaacaggcaacctacagaatgggagaaaatgtttttgatctatccatctgacaaagggctagtatccagaatctacaaggaacttaaacaaatttacaattgaaaaaaccaacaaccccatcaaaaagtgggcaaaggatgtgaatagaaatttttcaaaggaagatatttatgtggccaacaaacatatgaagaaaagctcatcatcactggtcattagagaaatgcaaatcaaaaccacaatgagataccatctcatgccagttagactggcgatctttaaaaagtcaggaaacaacaggtgctggagaggatgtggagaaataggcatgcttttacactgttggtgggagtgtaaattagttcaaccattgtggaagacagtgtggtgattcctcaagaatctagaaccagaaataccacttgacccagcaatcccattactgggtatatacccaaatgattataaatcactctgttataaagacacgtgcacacatatgtttactgcagcactattcacaatagcaaacacttggaaccaacccaaatgcccatcagtgataggctggataaagaaaatgtggcagatatacaccatggaatactatgcagccataaaaaagcatgagttcatgtcctttgcaggacatggatgaagctggaaaccatctttctcagcaaactaacacagaaacaaaaaaccaaacaccacatgttctcactcataagtgggagttgagccatgaaaacacatggacacaggcaggggagtatcacacaccaaggcctgtttgggggtggggggctaggggagggatagcattaggagaaatacctaatgtagatgatgagttgatgggtgcagcaaaccaccatggcatgtgtatacctatgtaacaaacctgaatgttctgaacatgtatcccagaagttaaagtataattaaaaaaacccagcaaaattccagactattaatagaaattgggaagcaagttaaagtcaatgattcctgtatagtgcagaaaacattttcaataaagtgtgttttatttttcagttaaacttctggtaatttataatcagtgatttccaaatgtagttgatcatcagaataccccaaggagctttctaaaagtgatgtccagggccaacatgctatagtttctgatatctgattcaagagggagaggtgggctctgggtgtctgtatttttaatatactggataattctaaaagtaggcaactctatgctactcatctgtataatctttttaccgtcacactgtcagatgattgtggagagatctttgtccgtctatggatggacaaagacgtgtttgtgtgtgagggagatagagacataaaaataacacacagataattcaccaagagaaacaggaagaaaatgccaaccccatgggagaggtagcaaacatttttttcaaagcatcagctagagtattgttacttctctagtatatagtagaacatatgtagcagaacacatgtagtagaaaacaggaaccaatatagaaatgaagctagctaaaactctatatttagaacttgaacattgaagatttgtactctgaaagactgcgaattctttgaagttaatgtaaaagccctcatacaaaggaatgtcagcttagccatgggtgggtctaagacaaatttgtatgatgtacaaaaggattaaaggaaaatctagaacctttgttaccaaagaaaggtgttctggcagatccaggacaaagaaaatctcttttcccaggtctgtcaaatgattttacatatattttgtgtctaccagctatttgcttaagtgagcaccaagagaaattgtgtatggttccatagtgtgggttcattcacacagggacaatgctgtctaaatacctttggtcctaactacaaaggttctttcaggaagtatcaacttcagccagatggaaccggccaacaactgaagcctcaaacatggtggccaaagtgagtagtggacatgagttatgccctgcctaaatgcagccttaaggctgttctgctgtaagaatacattataatataaatgcacacattagttgaaatcctttgtggatcatatcctaaagctgcccaagtggggctgcttaactatttattttgtccactatgttatgtgttttgcattttatttatttattaagagatggagtctcactctgtcacccaggctggagtgcaatggcaccatcttggttcactgcaacctccgcctcccttttcaagtgtttctcctgcctcagcctcccaagtagctgagattatgagtgcacaccaccactcccagctaatttttgtacttttagtagagtcagggttttgccctgttgaccaggctggtcttgaactcctgacctcaggtgatccgcctgcctcggcctccgaaagtgctgagattacaggcatgagccactgcacctggccttgttttatttaatttgagtcaaatggagatcacctaaagaaaaaaaaattgacttcatgttttctttgtcaccaaatgactttgtttttgactgaattactggggtagacactgcataaaagtattttttataggcaggagggaaaaagaggaacagtttgtgaaatgaaattataaaagtttcattttataagggtgacgacaaatgtgctagacctttttgtaatgttcacagccgaaaaacagaaattgcataaggatgaatattagggtctttcataagatgttttagtacatactgtgtgtcattaattaggcaatatttctatgaggtcaaaactaggacatctccagagtcctaaatgacatttccagctttatgttgccattcagtgtcttttatgctattttatttttttttcagtctgtttgaagcattgagacccacagttcatgataaaatacattcttcaattttagtgcatggttacaaaaaaaaaaaaaggacacctattggcatttagcaaggtgaccattcataaagttttgactatttatagtagttttcatgagacagccccagtttatatttggttttccagtgtaattatttaatagtataccagtttattctcaaaaactgtagatgatatattatgtggcatcccttaatatagttaacagagtcactacttatttgactttaacactagcggtttttgtgcttgtttaggcctattcttcccagctgtgtcttctccaggaattaaagctcatgttcccagtctttccttgggatccaaacactgtgaacatgatagaagtttgcaaagcttacggacaaataccctctcccttttcctttattattcttgacctcgtagagagaagtaacatacaaaatgggatagatcttaaatacgtattcaggtatctctgaccctccattctgtagatgatgtaactgggattcaaagagggtataatgggtttagcccatggatggcttgtctcttagaccagcatgcttttcaatttaattagtatttaaaaagggtcctaaataaactcactaaaaggagggatctgaaaaaccaagccaacatgaaggtggaattttacataaatccaaatgaaaccctgggtatttggaatcctcatgcagcacagctttgggtagaaagactgctaaacagagtaggacaagagggagttcctgttgctctagggtgccacctgcaatacctgggctctaggaaccattcctgtgacagcacaattaactatcccaaagtaggggaaatatattaaagaggaatactccagggaaggcagatacacatcttcttattgatagtcctattttcccccgtctttttttctaaatacacggacttctttaacttccataatcagaaataatctatttctcagagtccttattgtctattggacaaatccagtaaaagatatgcattgtgtttttcatatgtctttgttattttatgagttgatttgagttctacctctcctctgagaaaaccaaacaagaggaactctgtaatagggaagactgtgactagaattaaggactcatatattgaccactggggctgttaatcatgaggatggatcaataatagagttcgcagaatatctgaaggtcattaattgtaccttggatttctaccttcctggaataaattaggaataaactgagtctttccaaaagcaaaggaatacatgaaaccctttcttgctttgtgagtaaataactttgcccttttggagactcatgttctcatctattacagaaggaaagaaaaaataatggaaaggtttatgtcccagaagttcctgattccatggtgtgtccctgacgaggtggtgtctttgggaccagtgctactaacaagtgaatattgagaaataggatagacacaggtgggaaaatatggctgctggtttcacagaagtttccagaaacacatagacaatatcctttcccttcgctctgcctcctcacaaagacattccaaagggcaccaattccttggatcaccaggtcatgaggaccttaggtctagaatagcaagtagagtgctctctctgttgggagattcctatcatactccggatggcaagaaaacaaatatgcaatggtatctctcagaactggtttaaaacatgccaaatgtgggatcttggcctctgcctttctccagggccagtcttatggcaaaactccatgggatgggcctattctaccgcattgagaccaagaaaattccaagactccaccttagcaacatggacgtatgatgaatagaaaagaataagaaagctgtgatttttcttcgaaagtaaaagttttaaaaaatgcattgagcataatagactgtcagccatgctatcaaacttaaaattatagctggacccagcagactcacaatgtaaatctgacaggtagggcaacaggcaagtgttgcacaaatgcctcctgggaccgtaacttcaattcatctctgaggaatctacatgaaagctccactctccctaatactcatgcccctataatttcatgctctgttctcaccatgtggatgaatacaaccttgaaccatgtctacatttttcattttatttcaggcaaatgaattccttgcaggacatattgtatgtgaaatcaggcatttttcttaacattgcctttgagcattgccacttataattctaagaaagccagagacattaaaaggaacccaagggaaattcgtagttgaaacaaataacaacaatgcattgactttgatattctttacccttgtccacactggcctggagttcagtcagctctttagcctgcagtgatgaagcttggagctgcttttctgggggacagcacaatggaatagagcctatttcaattccaacattttagggtgtctacattgatgtagccaatctttgaatttcgaagacattgcgaatcaaagcatcgtatcaatgtcattatatgttggagagtatacttagataaggcaaattgtactttcagtgcatatgttttagttgtgatatttaacattttcttaataggatttactaagcaccttaaagcagaattcagtgattaaagatatatctcagccaggcatggtggcttaggcctgtaatcccagcagtttgggaggctgaggtgggtggatcacgaggtcaggagatcgagaccatcctggctaacacggtgaaaccccatctctactaaaatacaaaaaattagctggtcgcggtgataggcacctgtagtaccagctactcaggaggctgaggcagtagaatggcgtgaacccaggaggtggagcttgcagtgagccgagatcacgccactgcactccagcctgggtgaaaaagcgccgtcgcaaaaaaaaaaaaaaaaatgtgtgtgtgtgtgtaacttttgccaagtgctagacactattctagatcttagggaagcagtgatataatcttatcctcaaaagcacacatcaagcttgaaagagagacccagaagaactaaccacactgcacataggatagatgctttaatagatgcatcagtaatttgctgtggaagcaaagaaaaggcacgctgagaattaactttgctctgaacagtccacaggtgataattggggttttagtggggctttgagagaacaaagacttcacagcactcacttttgagaatgtgggttgtattacgtataactttgtgatacatatacatttttaaaatgaattattaaactggttgtttactatgtaacaataaatagtttctagcattttatactacaaaatctcttttaattcttgtgacagtcctatggaaggggtaatactaaaatgccttatatagataaggaaagtgagactcagagatggtaagtaacttactcaagttctcacagttaccaagtggcggagctgggattagaacctggtctatcttgctccaaagtcccagtattttaatggacctgtttgcttgttagcagtgaccttactgattggctaacccttcgtaagatcccacgatgaacctcacttcccagaacttggcctgaaaccatgaccaggagagattagtgcctgacttggcatctggggattctctgtttctttcagtgtcagtttcagtactcaagtggtcttgggacaagttacataaaattgaatagccctactttcttataagtaaaatgaatataatgttcccttcattatgaagtatttagtagggtaatctttaacctatacacgtggacagctaagcacacagtgctaagcacagggcacataatatggtgtccacaaaagtgtctgttaccatatacatttccgagtaatttgcaatagggcaatttggagtatcccaacctttgcgctaatgccgtccacagtgtctgcttctgtctccataggacaaagtgaaagaactatgtgtaaaatatttctgtaacttagactgactttcacactaattagtcttggtttataagcttttattttactttttgttactaatcctgagttattatgcaatgtctggtaagccaaaggattccacacgcatttctaaatgttaatgcttactgaatacactgtatcagcttttggactgagttgtggtcattttattaggaccctattatagtgcttatgatgttatcccctctttgacttctctgactctactaccttccttgactccacttggttgagactcccggttgctgtgacatgggaaagtcagttttaaatcatctcaaaggcttcccctccctccagcagacctgaacaccccagggctactgggctgtgtattggcaacacgatagctctgaatcccctctccagccagccagccctagaatccagggactcacctgttatcctcccatccttctgctaaggtggggcccttgtgattctcagcaacccagttcccaggatcaggtttttaactctgtggttcaggattctgtttgctaaggacctggcataagggcttgagtccagcttgccctgggatccgaccttctgacaaacaactacatacatgtcaaactgcaattaatgtaagccaatgttaagacatttctattaagtaaagtccatactttattcagatgtctttagtttttacctagggtattttttgttcccagaatcccatccatgacatcacattacatttggtcctctcatctccctaggttcctctgggccatggcagtttcttggactttgtttttgatgacttcgatagttttgaggagtcctggtcagatattttgtagaatgacccttaattaggattgagctaatgtttttctcatgattagcctgtgttagtgtgtatttttgggaagaagactgtaggtgtaaagtgccatttttattgtattctattaagagagctatatcaatacgacttatcactattgatgttgaccttgctgaggtaatgttgctgggtttctgtattgtagagttactctttttccctctcattttatactttactcttgctggccaacctttttcacttaaataatatcaggtcaccaccaaggatagcagagataaaggagcttagataaaagcctgaaggaggtagggagatctaaagcctgaggctattctgctttgggtttaatttttttcttgggtccagtggtgtgaaaaattgaaagaggtttttttttgctttgagaacaatgaggagcagcccctggcaggtggctgtaagccagtgtgtcagcacaggggcaggttgcactgactggagtggcccctgtccccatgtctccctcagggttctggcagggcctggctgcagggctgctaggggccatgctgaggtccagtcctggtgatcatatcaggacaagcgtgcacattcaagatgctaagaacaaagttcccaaggatgactcagctgtgctcaagccagggcaagtctgataggccggagcagggtggatgcaggagccaaaggtcagtggcctgggaggactgagaagaagccacttcctggccttaaaaagatgaggagtctgaataaattcctagaagaagatgaagctcctttcctcctcttcttcttcttcttctcctcctccttctcctcctcctcctcctccttcttctttttttttttttttttttttttttttgccattggccacatagttaatggatgggtagaggaaatttaaacagaaccaggatgattgcatcattctaaatgagcttgtttagccccttctagaaggaggaaggtgaaggcccctgttcaggctgttccctggaaattacgttggcatttcttgtgcaaggaagactgaatgaaacattgaatgaaatatatctgtctaagaaaaccagttgctcccaaatcctgccccttgactgacagagcagcaactttgaccgccattcacatttcttggagagagaagtgtgtcagggtctctacttttaaagcccagtagggatgttcccatgagaactctggcatgcactgtgtggcaattggtacctccagggagggtgcccctcagtttaagcttccagtgtctactcccactcaatctccaagcttcagcctttctctgtgagatgtgctaaatttgttaatgtatccactaatacaatccagaaactaatactgagtgagcgagtgaatgagtaagcagaggcagggatgaaataacagcatctttctcaaataactctcttcctttcctttctaactggaatgtgtccctgtggccttttcctctaagagacagtgatttacagaaacaaaagctattgggacccagtttataaaatgttcctgactatattctaccatccagagtggagcacctgtaattgatccagaaattctagttgatacagccagtggaggaaattacaggcatctacaaacccaactgatccttttatcgtggctgaaatattcgatcattcacttacctagtcatttcagctttcaaaaaattgagtctaggtagttctctgaccaaattaacctttttgatgactgtgctaaccatctggattaatcaccgtggtgaaagctgttgtccacacagagttttacgagtctcatttcctttgacctttattctcaccacccagttatctgacaacatgtgtctaaaaagtgaaaaaaggtccacttgctttacactgaattcaataatgtctgaccttgctcttcagctgtagagtatattgtttagattgtgaaattgatgaggcgagaagagatgctgagaggaaaatagctgaaatgcagggagagcagatagtgcagtttgcttacatttaaattaactgatgctaatttatttacttattatatttatgggatgcacccattacttattagcctctggatacatgttaagaggatcataaaagagacactccttgtcattatggctaattaacattcaaattgactaacatttaagcgctaagaataaaatcggtcatgggccagtcaacattttcatcaaatgtccttaaatagaatccattagtcggtcccctctatttttctacctgctgccaaaatatctgacaccagaggatgtcagagttgataagggaactatatctgtagcattgcagcaactaatatcaggtgtgtctctggactcatgcagggtagtatgcaaagcttgattaaatggacatagcttcctctcagaagaggtttatagtccagctgtaattgatgtagaagaaatgaacacaacattcagggcttttatatcctattgttctgaagttgttttgctcacatagccgcagcaattactaaagcttacaaattagggtgtgtgtccaatagtaagtttttctattgaatatatacgctgaaagatccttgagctattgtaaatccatcgaactgaaatatgtaggacagtgagaaatactgaatggacaactcagatggttcttttcataatttctaggaggaaaggactagaaagggaaggaaatacatatttgtcattaacctaccaagtaaatctctacataagcacatatgagtcccacattaaaatatgtgcatattaaattttctgtccctttttccatttatgttcttgatgttttcactgttttagctctgagttgaggttatgctgaaggcagttgggggtgactgagatcaggcagggagaagataagctgtgaattatgaagatattccactaagtattgtgaggattattgttactaggtgagaaccagggtgatattgccggatgagagtcaatagtttcacttcaatcagacttttggtaaatttacatttttgaagaatcctatgttttaagccatgaaaggtgctccatttaggctaattttaaaagaataatctccatgtgaatcagaagttcaagccaaattagagatttaaggttctgtgtcattttattaaaactcaatgggctgctttagaatttggagcatctgaagttaatttttagattggtcattcacctagtgtagtatataggtgaagcaaatgggctctggagccagaattcttaaactcccaggctagccagaaacctcgggtacatttatttacctctctgcggctcggattccttcccagtaaagtcgtgaagataatagaatccattaattcaatgagataataaggtacagtgcctaacactgttcctagtatataataaaggctcaatacatcttcagctattgtaattctagttaattaccaatatattaccaatatatagcaacacaataataattattaacaactatcattaactaatcctatattaacttaaatttcttctcacagtggttcattagtccaaggaatatttaaattcagttttctttccctaagatggtacttcagggtgattgcaatggagcttctaaactttccattcaatccctttcctctcttttttttttttttttttttgtcccatttcttagtgaaatcctcaattctaagccttgcatgcatatagaaaattattgtcttaccgctctctgtggtggtggagaaggtgtgtagggagatctagtagcatcccagtgagggctaagcttagaggaagtctcatctcctacccagaactgtgccttgctagagtcaggtgggggagaaagggcagggctgcaacaaatgaaacaccaaagaagagattgaaaataaataatgaaagaggtaaatgtggagaatgataaaattaagctaaggaaaaaaatagacataaagatgggataagtgtgtctgttgggtgtatgggaacaaggttcttgttcagaatgatagtcttatccaggattagcttaatgtgcaagaagagtttcagggccaggaaactctagctcatgccatccatttaatacatagttaatgtgttcccactaggtgacaagcactgtgctaagcattgtaaatagagtgacgaagaccagagacatgacctttgctgccataacaattacactaagttaatgggaagacttatattagtaataatatttgttgacaaccatgatttcaaatttattattttgcaaataggcagagcagcagctgttaatgaggaatagggaccaaaagttaattagtttaatggattagctgaggaaagactaaggatgtataaatactttttttagagagtgcctaaggaactgcttatggttctggaaaataactacagggcaataaagagtaagtaatcaccaaagttgggccttctagtatgtttcaagactctgtaactcaccaaagtaaaacaaactggccttgccaaatcttgaaaaagcatcattgtgcagacggatttgagcaggactttgttttttttttttgcatcaaatgactccaaatttcttggggattttccattgaaactatttttaaagcagcttctcccctagttgctatcatcagagagagtggtttttataattttataagttagcttaatttgaggacactgagggtgtgtaagaaggtatggactagagaagctaaataagaaagactgagaataaatattgctgtcaaatattcgatagaattctaaatatcttggtgttgtgaccaaaactcccctctccgagtcctggtatttgtagaaataattttggctttttgtgaagcactagcccagtgatcagccacttcttctctccaatagagaaaagagaaagcgcttaaataagattgaggaggcactgctcctgcttcagagctccattatgttaccattatgagacatttattgagcaccatcattttaaaaatcagagtaagatgtagtcccttcttcacagtctggtgctctcaaagaactaccttatcctgaaccttcaattcattttttttcccaatatgcatgcagtttccccaactcagctgggtcccgccacctagtctgtcacaagcccagctaatcctaatcctggttggtgactaaagtgctaggcctcttacaagaacatcaacagtttcatctaacacggagtgagcacttcaggatggaggttaggctttaaaaagtgccaatcctacccttatgagctcccagtctcttcatctgtctcctcccacccttctgtttctatcatgagtggcgtgtagagtggatgagctcatgccatctgaggtcaaacccagcctctctcaattgccaaccaaatgtcacaggtcagagtacacgatccagctaagcctcagttttcttttttttcccttcttttctttctctttttttggagacggagtctcattctattgcccaggctggagtgcaatggtgcaatctcggcttactgcaacctttgcctcccaggttcaagcgattctcctgcctcagcctccagagtagctgggattacagatgcgtgccaccatgcccaactaatttttgtatttttttagtagaaatgggatttcaccatgttcgtcaggttggtctccaactcctgacctcatgatccatccatctcggcctcccaaagtgctgggacaacaggtgtgagccactgcacccggccaagcctcagtttttttataaagtggtgaatgttataggtggattttgagaaaaaggcaggctaaactaggtaagagagatctgacatgaaatgctcaatatacctaagttcttatttttattatctcattatctcctaatactccacaatcacatgctctgagcagattggaatactctctttctcaggaatatactttatctctctctctactccttaaaataacattcgctttatcagaaatgacctccttatcccccaattcctctatcaccatccagggttaccagatttaacaagtaaaaatacatgacatctagttaaatttgaatttcaaataaacaaccaatagtttttagtacaagtatgtcccatgcaatatttaatgggatatgcttatcctaaaaatttatctacttatctaaattcgtatataactgataatctgtctctttttttttttttttttttcttgaggtggagtctcgctctgtcacccaggctggagtacggtggtgccatctcagcttactgcaacctctgtctcctgggtccaaacaattctcctgcttcagcctcccagatagctgggattacaggcacctgccaccatgcctagctaatttttatatttttagtagaatcggggtttcaccatgttggccaggctggtcttgaactcctgacctcaagtgatccaccacctcggcctcccaaagtgctgggattacaggcatgagccactgtgcatggtctgatagtctgtattttatctggcatctctccctcctccattgtctcctgcctaccaagccctatctgctattgaaaatcttgtttgcgggtggcaaactcaaccaggtagggaatgctgatgggtggaagagtcccgatgaggatgtcgtaatggggcagtgtatacaggggagcagcatctcatctcctgcttgtttctatgtgtgaatgtaaaacttgtgttgctagtgtccccagtatttaagggtagtcagaaattcaaaaaattaagtgtgtgttatctgccaatatttaaacgttgaaactaatttaaaaatcactcaagggtcgcaaatttgaaaactccagccggtataattacatttccccccacatgactttccttgatatcccacacttagagatgacatctcgttcagctgaattccctatagggagctgcattcttatggctcagtattaatggccctgtatggtacattttaattttttccaagtagactataaatttgaagacagtagaaacaatgttcatttttttattctccaaggcttagtatttaatgtgttatcagttgaaagaatgaataaaggaatgcataaatgaataaatacatttcggtttagcaggagtcagcaaagatcactaatagggtcaacaacaggagtgagacaaggcaatactgagcaaagcacagaaatccaacacttttcaaaccatgaccaggcagcaacaacttgatcccgttgtggtattttcttgtggttctcaattaaatacatttacttgaggtgttatgaaatgagttaaattcctcctctctccaacagctgctgtccctcaggcctcagtcgctcaaacagcccacagcagataggctgtgtaaacagaagcattcccagtttacttagggaaaatccttatgtcagagcacagagcacacggccccagtgagaacggccagagggttcctgaagtggccttcatcagtaccctagccagtcttatatctgaagtttttagccataattttttccctggatagaaattaattttaagtcccacaatattaataacagcattaagaactaatataataaaagtttattgactaattttgcaccataatttgtgtttgattcttgtgctgccatgtttttatgaaatggaaacactgtttgtaggctgaataataatgaaagaaaaagagcaaatgatactttgaaaatcattcattgggatttaagatgttttgggtcaggaaacttaatgctattttcatgagggatgggtagaataatttaaaaaataataaaagaatctgcccaaccagagaaatgcttaagaatacataatcacttatggtaggtttatatattatttggctatactcagaaattgatgtctttgtaaaagcctttttagatcatcaacaaaggagaagttgagagtacgatcaagaatctgttatcaagggctaaattgacatgtgtgattgtcctatcaccaccatgggatggagaataataataataataataataataataacagttaatggaagttaaccagtttattccaggcaatgtgcctaccatttcatagccacaatctcatttattcctcataaccatcctatgaggttgattttcttactagacaaggaaatgagtccagtagttagccccaagacacatattcgtgaatgatatcattgaagctttaacccaaggtagagtatgtacctactgtgcctttgacatggtctcctgctataatactgcagcacaaacacaataggaatggaaaccagggagcttccatcaaactccagaacattctcataagtgacagttgaaccaagggaatatagttaaagtaaggtgccttttactgggacatgagataaaagagttgagtagcacaagcatcagaatcagaatcaggcataggaaacaggctcaagaaacaaaaagatcaaacacagtgtcaggagtggacattggggtcagagtcatacattagagcaagggtcaggacagatggagtaaagacctaacatttagaattagaaatatggttaaagaacagggacagaaaccatccattctactataatctctcaagaaagatgattttctcaaatctggtaggtgaaggcttgctggcaagagctgtattataaagggtgctcggtgtggttattgtgccacgtgactgtactacatagccctgagtgatggttattcttatagtaaatttggatgcgtggatataattatcacttgttgttgaagaaccctttaaactagtgaagtccgaatcttactttttttaaaaaaaatattgacctagtgtttttcctttggaaccaaaatcttcaacatctcgtgctatggaaaacaaaaaaaattcttcagcggctctctccaattcctgctcaaacaaaatgtaccaccttttaagcagtgaagagcacacatagtggactgcttttaatgactcattctgtttaataaatgactttgagaaccatcgaagacggtgtgagagtaggggtgccaatgacatagatatgcttctaggagaatatccaggtatccgtaaaggcagacccatgccaaggccttaccattattcctaaaaggactaaatgactaaataacagtgtgtgtacttggacagggggcattgtatccccgttattggaagaggttgggtagcttcccttctccagaatctaaccatagctgttgtccaaccaaagggtccattaccagagatgaatgtaataataatggagttggcagcaggagttaagccagaatcttctgtctgcattgatcacagggaagagacaagtccagcagagatgctagcccagcagcctggtgtccattccacctctcaggtgctgggctgagatccgttcttgaacagggaaggatcagaagaacttaaggaaagttaaggtcatgcttgaaagacctctgtgtatcaaagggaaagctgccaaatccacaagggtggggtagatggtaacacaactgatgaaatttggaactttacgagcccaataccctcaggaactgagaagggagctaagagtcaagatagaagcaaagcatggttcgagacaactgtttgcaaggagccgggaggctgtgccttgtcactgggtaccagctatgtggtgtgtggtattcagctaggtttaaaggcatatggtcaggtcagaaaaagaaaacaaaaatccctggctttgaatctgaggagcaggctgagagtgaaggagatatttcccccatctcttaatattctcagggctacagtataatggaatgagcctgagcctctgaatcagacagagctggtttcaggttctggtttcattccctgttacctgtgtcaagctcgccattttcttttctggcctagatgcctcttcctcatttgtaagtgaatataatcatatttacctcacaaaggttttcaaaatttcattgggaatgtcaaccccggagcctgagtcaaagtatatttttaatcttgccattaataacgataacagtcctaataaaagatcattttagatctgtcattgttggtaagccgctttctcttccttcattcaatccaccattgtggctcaaggaaatggctggaatgaattaactttgggaaagaactagatataatagtgggagaatcagtgctggagagagaagtaaaaagccacctcttatagctctggtggattatgggaagcaaaagaacaacagcaagaaaagcaagggcttcgtcataggcatcctggcctccattctcagggctgaagtgttttggggaaaatgtgttagagaaaggtgaagaggaagcagaggagacagatgtgactgtctctagaactctggaagaaaaagcagagagatgcgattgctgtgtagaagggtttctcctcccaccccctgctcctgcccgcaaggcaaggtggctgcaaggaagtaaaagtgatgggggcaggatcgtgggtgttactgctattctgtctggatctcctgtaccagcctgtgcatctctccccggatactgtattgtctgacaaggagaaactgttgttctcttctgttgttgccctcagctagacagaagtcactgagccggagaaacctagtggctctctctccactcagcccctgtggcccttctgcaatgaccatctgccgcagggcaccagggatctccagatgggactcatggctgctgggggtacagtttgtgctcttagtttccctgtgtgatcagatggatgggaatctcctattgagataacattcttttcttttttccacttttgttacttttaattgatgcacaataatttcacatacttacggggtatgtgatattttgatacatgtatacaatgtgtaatgatgaaatcagggtattagcatatctatcacttcaaatatttatcatttctttgtgttggaaacattcaaaattcaagctatttaaaaacatacaataaattatcgttaattatagtcaccctacagtgctacagaacaccagaatttattcctcctatctaattgtattttgtgtttattaacaaacctctcaccattccccctttgcccttacccttcccagcctccggtaactgctattctactctctctttctatgagatcaacatttttagcttccatgtatgaaagaaaacatagtatttctttttttgtgcttgccctattttaccaaacatagtgtcctccaaactcacctgtgttgccatgaatgacaagatttcactctttttatgactgaatagtattccattgcatatatataggccacattttctttatccatccattcattgatagacacttgggttgactcctctatatcttagctattgtgactagtgctgcaataaacataagggtgcaggtatcactttgatatgctgattttctttcctttgggtaaatactttgtagtaggattgctggatcatatgatagatttgtttttagtttatggcggaatatcagtactgttttccataaaggtggtgctaattcacattcccaccaacagtgtaccagcattcccctttctccacaaccttgccagcacttgatatcttttgtctttttgataatagccattctaactggggtaagatgatatctcactgttttgatttgcatttccctgatgattagcattgttgagcatttctttttgatatatctgttggagaacacaatctcactggctttattctcccctcttgctgggtttcctcattccgcttttcttcaaagaatatcccgccccaataagtcacttggataggaattcttactctagtgttcagggagaagaagagctggggttagccctacctggattcactcagctattgcatgatgggaaaggacctgaaagttttcacatgactctcagaagtggagagttcctggaaatctagctggagagcttgcccaaagggttcactacagggtagtgtgagcctagggccaaaagctatctgggggcaggccaacctgcctaagacctgagtgggagttccaggtactaagaaccaaggtggttcttaggattcttgggagcattgtccatgcagcaaaagcagagctatgaataacagcaagaaaaccagcagaaacatccagcagcagaaagggagagcgtgctgggagtcagcaccagggccagcacctcacacctaaaagccagcccagccctttgcagtcaaaagaccggcacaagacaaggggccacccactccccatgccttcacagtcccatgacaaccacattccatcttgggaaaaaggaaggaggggagaaaatttaattgaaagttaaattgtgagttcacttaatttggtttcccacaaagttgttttaactccaaagacaattttaacaaaaaaataaattgagatacattagattgcaaatttaagattttaattatctggtggggtgggtgcttatatataaaaaggtggaaaccacgttgtctttgcctgtctgagttggggtgtgaaaaaaatctgtattattaccgtgtgcatcttcctatctgcttcacatgggaatggatgtggcttacattaaaggcctcagacaggggtcaagaacaatcacactggcactcagcttgacttgaagcccatcaccctgggggagagcagcccactggcaagctgacaggagtagcaagtcagccatgaggatttggagagaaagaaatccataaagtgtgtgaatgtgcgatagcctttggtgcttacaaagatatgactttttgctatagcgatgcttctgggatgaatggattataacaggaaatacctcaaaacccttttgcttcagccaaagcaggagcagccctcagtgaaggcttggtcaggggaacttcccttgcagttgatgtggtcaactctcttccctatggggacatagtggggcattcccatgtcagtctgaatttatagaatttcaccactgagcactccttgttgttaagtatggcagatgccctgctccatagaaaataaacaagtgcctgctagcgagtgtggtaatagagtgcagcctgcatttcctgccttccactctagacctaccttccctttttcttccaacctgaagcacaattctgtggatgatttttccctccacctgacctcagatgagttcattcatccatttatcaggcacaagagccagttgaaacaaataaatgaagtggaaaggaaagggagcttggtgtcccaaacccctccactgagctgtgactcaggaattacagcacgttgtattaaatcatttctttgtgatgcattggggccgtgtaaaagtcgacagtgacatatgggaaaggccctgttagcaggattggggctgttgtgtgataaatgacacaatatgtcaaagaacatctgttatccatcatgtcggcttcctcagaacacttgagatggagagagagggaggaagaatgaagaagggagagagactggtagacagtggctgagaggtgggtaaatggaaaggaagcaagactatacacagctgggagaagataggaaaatgacctgctcaccataagagagccgacatgattcaagaggatgagctaaagtgagtccctccagcaacctgccactctcctgtccctcacatctctcttccctttatgttttcatgttttttggttgtttgtctaagtttaatcagttgagcatattaaaccttcatgccagcaggtgaggaatgggagctggctgcacagttgttctgttcttttccctctccagacgcactgctctggtgttgcataggatctcttctgagccagagaagctcaagggagcattctgcaacttcattggcatagcaagctgtattagaattgctcaagtgaatgctctgaagccagtgtttgagagcaggttttgtgccagcagggaacttggatttcttagcacttcatccttctaacattcctgtcacacttatgcaaatgcctgcaaagtttctgattattttatttcatcagaagaaacttccatttatatcgaatctctctttgtgatattatatctgtgactctttcaggatggggccagggtacccaggaggatagatttcgactccccttaaagatgcaactgctcatcatgccatctaagagaataaatctgtgttagtaactctgaaagatcagaatcagacatccctgcagctcatatgcttttattttagatgaggttacaggcagaaatgcaattttgaaaataattacactgttatatttacagagttagtttccttggtactcatatttctttctaagcattattttatatcctttaaatgtatatctggattgttgttctgtgttacagaagcaaataaaggaagagacagaagcaagatgctttgatccaacagtctggattacctgagtgggttttataaaatgcagatcgtatactttagaacaagattctgattcagaagttttgatatagggcccataaatctgaattttttgtttatctggtgattctgatgatcaatgtagtgaagttattggtttcagcctaaaaattaattttactcttttcctgccaccagtacccaaatttccttctgtgtatttaatttccgcctcttctccaccatgtggttatttttaaaagatagatccacatttgtaccattcaggccaatggtagagagtaaatcctaaaacctagagctactgcaaatgactcttttcctctgaagacagtggataaagatgtgtgagccgcggaattgtagtggacattttgtttgctatagccagggaaagcctgaagctgttgggcactgccatgtgtagcctgagaatgaagctgacaccgtggaaagcagagaggagagatggaaagaaactggatccttgatgtatcaattgagcttcttgatcaggcttgtctgacttgaaatctatgtctaggtatttcagcaacatcagtcaaagtgtttaagtcaagatgaggtgtgttttaaatcactcaaaaccaaaaaagtgccacctgatacaaatagccacactgaggaaaccttgctctaagtctcatcccaaataggtagggaatccaaaataagcatgaaccagacactagattctaataatacttactgagtatctggtagggccaagcactatttaaggccagcgcggaatatctggagttgagaaggccagttctttgagattttctgaatacaaagagaggacagtataccttgtaaaagaactaataatataaggcaacacaaaaggatcaaaacagggccgggtgcagtggctcatgcctataatcccagcactttgagaagctgaggtgggaggattgcttgagctcaggaatttgagatcgacatgggcaacataacgagacctcgactctacaaaaaatacaaaaactagccgggggtggtggcacgggcctgtggtcccagctgttccggagggtgtggtgggagggtcacctgagccagggaggcagaggttgcggtgagctgagatcacgccactgcactccagcctggacgacagagcaagaccctgtctcaaaaacaaaaaataagaagtatcgaaacagaataaatgcaatcaataaatgaaaggaagttagaggagtaagaagcaaagctcatcatgggccagagatgtagaggaggtagtatttggatttgttagccatcattgtttacgaacgccatttcctgtctccttttttgggctactcttgggtaactcctgtgacaaaagggaagataagacgtcgattatctcaggtcagacaggcatccctactcatgagttaagcatgctgatatcattgagggtagagccatgcgtagttgactactacaaagaagaggctacatgaattactgatctaaaaattacttaaagatccacctccccacccattgtcagttaaggaacaacacttcggatttttagcagtggagagatgcacctggcatatctgggaatactgatatgacagttgtgtctagagtgtcttagaggaaggtgaattagaagaaaggaaggtccctcaagtatctaggctaacatctctttagtctctgattgaatgtgggggcaatcagattgtcagggagaggctgaggccaggtagacacaagaatatttagtaattgattggttatggaggataaagggagaggagggaattagatgtaattatgaaatgtttaacctgagttactatgggacttagtgtgccattaaaatttaactcaaaagaaaaaaaaaggagaagctgatttccgaaggaatataattctttcagtttcaaatattttgaatttcattggctggcaagatatttgtatggagatatttgtggcgagtatatgagaaataaggatgtggtgtactgaagggcagtcgaggctacaggtgcagctttttggggtaacaataaaagttaaagctggaagaacagatacaaagccccataaagagtatataccgagaaaatatgaggatcaatgccaaaatatgagtaaatttctaaagcaaaaggaagaaatggaactcagaaaataaatagagataggctggtcaaggaggcaatggtaataacaacaaaacaacggccacaacagtgataactgtgcctgtttactaagtgccagacactatgcttaagcactacatgaatataccttagaaggatcaaaggcattttttctctcccaagcaaagaaaaaaggatcagaggacagatgtaattacagaaaaatccaaggcaactcatactggctgtctttcaagtgggttatgagatcttcaattggtagaatggggttctgcccttgagaagcatattcaacagtggtacagtggttgaacgtctatgctatggagatggcaagacctgggattgaaaccctggtctgcacttaactagctgtgtggattcttggccaagtggcccagtttcttcctctgtaaaaatgtggaggattttacctaccacacaggctcatggcaaggattaagtaatgaatagcacataaagcatccagaccactgtctggtacagtgctcagcatatgtctattaagagtgtggagaaggtaggaagccttagctgggactaggcagcagaattctgttatgtgtccagctaaggcagcctcctggtgttcagtgaggcagattctgggttgttgcatgcgtgcctgtgagtggagtgactgaggaacggcatgtccaatccttccacccaggagagccatactttggcttgctatgatggccagtgacatccatggctctgtaggcagagaaataagctgcaaataaaacccctttctcttttgctggcgtattaaaaaaaaattaacagtaaattgtggcatttcaagcttcccttctgtgtgccatctgttcacctacccatagtcctgcatgtcagcttactccagcagcttataagtacccctgccatcaatgcccagtgacttctgactccatgaacattggcctgttgaaaatcatgtctctatttatctagataaatcgattgttgcataaagccattcagttcagccacctcccgtgatgcatggggtccatttaatgatggatttgactgttagctatctaaggcagtaatgcttatccttgactatccattagattctcccaggagaggtttatgtttttactccacattttttccttgtcaaatccctaccctggacctggtgcattagaatttttaggtatgaagttgggacatacatatttttataaggctccctggctgggtcggatgtacagtcagcggtaaaatcatacctataaggaaagaagtctttgaaaagttgaactggatttgttggttgactgtttgctctagaatgaagtgtttggggccacatgcttcctgtctcctagattcaacctacagaaattttgaacagtattcattctgtttattcaggccggagaatgactacttacttacccaaaacctaacttttttgactactactatttaagaatagggtcaaaatattagaattggggttagagatatttggactcaaattctggcttagttatgtactgactgtgactttgaagaggctaattcacttctttgagcctcatctataaaatgcagacaacacccatatcacatgtttgtggttagggttaaagaagatgctgcataaaaattctctagctgagtacctaggcatggaatatgctttaaatagagccattattaataatattttatttatcttcattagttactgattaatcaatagatattcttactgcactatccttataatattccagctatttataggtttatgttgattttttttcttggggtttgtcatcagctaattatatcttctaggatatgttttaacggatatccattctttctttgagaatgttaatttagaaatgtatacatatgtacagacatactcaaaagaattagttattgactttctaaatatacagactcattacagaacatttttgtatgccttgagattatgttttatgcctgaactggttagacactttctttcccacccactaaatttcagcatgtgtgactttctcagtacttcttgggcctcccattgcctttgctattttgttctatcattgctggtcatgtaagctaagaagagaaagagtgtaaatgaaggcagagggaaagaaggaccttagagacatctaaagtgtaggaagtttgaggatagagaccttgttctttgcattcttatatacccataaaagttgtttaaaagaaatacttgtttaactgaaattgtgttataattcttctttactaggatctctcagaaaacagcctttcttaggcttctgaatatttaattagtttcttcttttcacctgtggtcacgtggccaaactttggccaaatagggcttggaaattctgattaaaagctgtattaatttgggataccatgggatagaggtaattcctccaaaggaaaacccagttgctgctacctaccaaaaggagaaatgaatagtggaaggcaagagcagttcatgtccccttttccattttccattacctaccagagaccaccttctcaatgtcttttccatgtctccctttttctccaggccttggccactgttctaatgtgctttcctatctcctgcttgttttctcccaattctaatatgatttgcacatgtctgtaaaattaaacttcccaaaaagtgcatttaccatattttaaaaccttccatcatttctaatcctcactggataaagtttgaactcttctgcctggcattcaagaccgtaaaaaaatcttgtcttttaccaacattgatgattttattattcagaaatttctacttgaaccagctgttcaatgaattggctcttatatcctaaagacagcctcaatggattggtggaggagccttatgccagccacagtagctttgcccggacacattatgtagactcattagaaatcttaggaataatctgagcataatctctagactcatctcctaacattcctggaattcttccctgttccccattataggcatgctttgtgtgtctatcatgttgaaaaactcacaggtctccaggcaggccaagtggccacatgtttgtcccttagtatgtggtattccctttcttgagtgtcattccacaatctctttccagtgctgaccactctcacctggacacttgtctcagaaaaattgttcctgatttctcctagtgagtgggagatgcctctgatttgtagcctcatgatgcactgaatattcccttatgacactgtaatgtaatttccatttactctccctgtctcaattacaccaggaactccttcatggaaaaattgagccctccaaatctttatcacctgtccttagcacatgcttagctagtgtagaagctcagggatggtgcaaactttacctatcctatttacaccctgtcacatcctagtgcacagagaaagatggggcacaaggaagctctcaacacagaagtacttcaatggctccaactcagtgatggtaaacaccaacgttcttactgaatgaaacaaaatattccctaagacgtgatcctgctgcccttctgccctcatctcctcacgctgtccctgacccacccttgctatttctgcccactggcctccttgctctttctgtgacactgcagtgtccccgaaagtgacaagtgtgttccagattcattctctttgccctgagtgttcccgctgctggaattgctctttcccctggtatgtacccggtctgctctgctcaataataacctaattaggtccctgattgtctgatattataaagtgctttctacatagcacatcctatatgccttacccttcttaatcatttccactgcccttagccttatgttacacgatatatgttcagtggtgtgtttattgtgtttcgcccttttctctatggtagttccatgagggtagggactttgtcttgtctgcgactctatcctcagcttctagaatatgcctagtacacagtaggcactcaattactgtttgttaagtgaatgaatacgtgctaaagaaataaaaggttgtaagggaacacaaagcatgtaaaataattatgttggacactactgaatatagatagctattcccaccagccattcatattcccttctctacagaaacagacagatacctaaattaaatatagatgcatgttccggaaacttcaaatccaatacaggcacaatggtattaataatacaaaatacatcatgtctaacattgctttgtgaaggagattgggaaaagagaggagagagcccgaacacttctccctacagcaattccgtaccccttttcataatattttggtagcttgatggaggcattttcttcccgaaagcagcctgacatttatccaggattgcctgaatttactgctgcagttaccagcaaaaagccatcaggttttagagttttctcatccgtagtaagctggtcaatttattttattagcatcttttccagtgcctgaccctaaaataactgatttcagtgtttacattcttagaggtgggctaatgaagaatctttggcagctactgccaagccctggatgtttgagtaaaactttgtaataaaagcaccgacaaaaccccagccttacccattggaaaaaaaatagattttgttgtgtgtagtatttttaaaatatcatattttgtaatagatatgatagatttgtgaataggcaattaaaagaattctgtaaattttatggagcttctctttccattcttttccaccttggtcactgacagacataatttgcctttttaaggatagactgctattttttactctttcttgttttcctcaattgccctcacccatctgtgtgactttttcttactctcttcactacgtatggaagactttgccctcacccatctgtgtgtctttttctcgctctcttcaccatgtatggaagactgttatttctgaatctttggactaaccttagaaaagttcccttagaggtgcacactgtggtggcttctgagagtcctatgcctgtccacatggagttccttctactatttttgcttatttcatcattaaaaatgaagctaattgttgccaaaaatatagaacgattggaactctcttacgtggccagttggggtgaactcatatacagccactttggaaaacatttttgaagttaagtttacaaatacactgatcatatgattcagtgaattccactgtctccccaagagcaataaaaacatgtccacatgattgctcatagcagttgtactcataatcaccccaaactgagaagtcaccaaatatttatcaacagatggatgaataagcaaattgtggcaaatccatgcaatgaaatactattcagcaataaaaaggaacaaaatattggtaaatgctacaacacggatgaacctcactgacatgatcagccaaataaaccaaacataaaaagagtacacactgaatgattctattttatgaaattctttaatagacaaaactaaactaaactgatggttgtctcaaaacagggttggggctattgactgcaaaggggcataaggaaactttttgaggtgataaaaaattttatatcttgactgtgagagtgattacagagatgtacccgcttgtgaaaatgcatcaaactacgctttagatgggtgcattttgttgtatgtaaattaaacctcaataatgttaatttaaaataaaaacaaaaaagcaaaactaatgcatgtttgaagtcaattcccactgaaatcttcagtggtcaagccgtctgtctacaggcagactattgcctccctaagacactgctgaccatttacccatcaggagaattttaggaaatttcattaaattattacaaagagcaagctctgattcaagacctgattttcctggcctctccctgggagaatagcagctgatgataaaagcaatgaaaacagtgcatatttattgatttgttgaaataccaggcatttgtaatgctgtgccagtatgtctggttcttagcacagtgcctggtacataggaggcacaccataaatattgattgagtagtagaacaaaacttataacaacgttacaatgaatgtatcaccattttatagataaataagccagggtcagagaagttaagtgacttttccaaagtctctaagagttttcaaagctatttttcgagcccaggtctctagcatcaggctttccattaaattaaaattcaatttaatgcaagatatcctgcttcccaattggttgggttgtttttttaatgtaaaattgttatgattatatctaaatcatatgcctgtattggctatcaaatgatttaaatatgtgaacaatctttgtaaactccaaagctttgtagaaaaacaagatgtaagcaatatggcttagcataaaatttggctttcttttttcctaacataataaaagctaacatttgtgcttaaaatgtaccacacactgttctaagtgctgtgtagtctataaaaatcacttaattctcacttaaaactctctgaggtacatatcatcatcatcattgtcttatctttgtcttcaacatctccattttataggtgagttcatgcattttttcccctgagttatagaggtagtaagtggcagagccaggatttgaatccaaatagtttttattcaaatctctcatagccattaccctatactttctcatccatccatctacctacctacccatccatccatcgttccatccccacaacactagtttttagcatatttccttgcaacacgtctgacaaataatgttcattcagtgatatcctcacctcattgtcattcacttcgatgttctgtatagatgaacagactgcaagttatgtatatttttctatatgtcagttgaaatttcaaccaattttaaaattcagaatagaaactgttcctctagattaaaacaataacaacaagcaaaacaatggcatagcttgtcttttattgctgccaatctgagttgggtaaattttgcattaataagtcacatcacatttatctgaataatgttctcttaaactgaaaaaagacacaaaggacttatcactccagaaagctatcttacatattccatccatactgtttctcttttccttctcttgaaaatatgttggaaaaatctagcatgggatttccaaattttgactcttcaattcaatagttaaagggcttatggccagaaagtcattagcattcttcccaatgaccaggcagcatgggcacagtagatgatgatgcctttgagagcagttgagaagaaaaacctctaactattgtggtattcagaggagaagccttcaaagggctagagaggtttactcttcaggttgacaggcatgtctgtaggctggatctcacatttggggcaatagtccccaaggagaataagttcagaagaggtctgataaaagctgcacattgattaggatatttcagcgaggaaactgtgattaaacatgcctctagagcaaatacaatttaatgtatttcatgacagttttgatgcttcattttaagaaaggaattgtgatttttttaatgaaatgtcagttttaccggattggttttataaaatagagcatatctacaatgctttcttgttcagactttataacctttgctattgtattaactaggttgaatgaccaacatttgaatatcttcaaaaaggattacctacattctgaagacagatacatttattaagtattccttatggattcatttcaaaaattatatatgtagagaaagaacacaccgctatttgccttgttagtaaactaaatggacaaaatccctttcattatgcagcctagctaatattaccacattcgaaaaaaatttcaaaatttaagaatgcacttcaaatacgcattcttaaaaaaaagctgttcaaagggacagaagcaaatatctttctatgtttttaaaatttatttttgcatgctttccattatgaaggcaactcctttcttaaagactaaaacccagcataagcatttggcctgttagatgtgcaacaaactccattttttttgtggcatgaacaaaaggcttttggtttgcaatcaggctatagttgacacactaatttttccctctagtaaagaggagtttcactcaacaggttcgtcgcagcctctgcacccaagaccccgctgggagccaattttaatacctgaaatattctctgctttctgaagagggcaggacatccggagaatacttgacattaagagtgatcgtaataaagttttgtcttaatctattcaggagaattttagagtcaggaaagtatgattagagcatctatgtctcgggaaaagtgtccccactgtgctttaagcttcatatcttgtagaaagatttaagaccaaataatcttaaaatcaaaccagattagaagtgctctggagaagaagtccaagagatatatcttcccagtagtcacattatataggatgatatagttttgttggttgaaaggatgtcaagggattatatgaattatccactttgacaaagttaaagataaaggttaataatctaccagcaaaagaaagggcaatgccagacacacatactccagccgttgcttctcataattcctctaagacctctctgggcctgggattagtgagtgcccccgattcttccatgtggggcccttggcctctttcaactgtcagtgctttcgatcataggggtagtctggtataaaaggaaggctgacggaataaaagtgaagacaatgcaggtttaatagggagaaatgattttcctactttcctttttggaagccaaatacactgtccccgtatattgccacttgaaaaaaatgagttaaaaaaatctgataacaaggctcagaaggctggcttaaatgaggtcaactactatgactaagtagcaatctgaagaaatgtacaaaaatcaagcctgtttttccaatatttggaggagagcttattttaaataaaaatcaaaattttaagaagtagactacaaaataaaaataactataataattttattatatgaaatataatcttgtaatggatatattatgccatatgtagtctatatgatgatgtattataataatttacattcgtgtaccaagaattaagctatccattttgcatcaattttctttctctctttaccaagtgacagatttaatgtaaactgattctgttacaattggatctaatttatagaaacatgtataccattcattccacggtagtcagtctgttacattgtttctatcagagctatcttttttagtgaattgggaacaaagcttacactaacaccatttgtcactgagcaagctgaactctgctttctaaatagtctggccacatcaattttctaacatatttatctcaataattgtatgtgagcaatacatttactgtcccatttaagagatgagaacattaaggcagagaaggttatagagctcaccaaaggcacaccatcactaagtacctgttgcagaggggttaccctaggttgcaggagataatttttgggtttattgcaaggctatcctgtgtagttaagtgctatgaagaaaattgcagctaagaaaatagaacggaaattgcagctgatttttgaggcaaatagacatattaaggtcccactgtgcactgctcaaagcctttatgaattaattatatgctacatgtctcgttaattactaacgtatcactgtactcaccttttgccttaaaagcttggtaaaatctcatacatatcctcgaatgaactactgcttctctatatgcttgcttacaaattatagtttgatccaagaaactagaagtttctgcttctctctggcttatattcacacgtgttgacatggagcatgtgtatgtgcagtaatcacgtgagtgtaataggctcccttgaatagtgcccacctcaaagagaacagctgcagtgttattgttttcagtgtaatatcacatttatagaacttgctgccaatgtggtaagatcaataggaattgcacttttatactaccagttttcctctggcctaatttcatgtagaccaggagcatgcactcacatgcttgagggaaaccgaagccacaacgagtgacaaatgttcatttgtccccaagattgagactggaataacagtactgctttctctagtttcagcttgcctaaaaatatgtggtgattaaatctttattcaatatgcttatatcaaacattggccataaatttcataattcatatttataaatagtttgggtgaaaagaaagatttgggaataaaaaacttaagctcttataaattttttcccagtttaagtcttgattctgttatatgattttattgatcactcatcatgccccagacacagccctccacacaatacatggttatctcaattaatccctaccacatctcaacaacagaggctcagaaaggtcatatgctttttggaaatggtagaatttgaacttaggtctctgactcctaagggtatattctcaagtcctaccgcattctgccctttgaaatcgatgcaggcaggcacagttgccattttttattgcccaacgggtacagctactcttatgaagcaatgcttatagtgaaatcagcttacatagctacagtgaccagtgatttgctatatgatggaaactccagagaatttaaaagtgaggaaaaatttaggatcaaggcttgagcataattgatggcaaaatcttcctgcttctgcaacaagtagagagaatagcttgtaaattgggccattgttatttttggtcagggccaggctggtcagattcagcaatagaagagtgtttacttgatactcggttcaatttggtctcctggtcttaggtgtcacttgcagctacttagatgtcaagggacaaactgcaccattaaaaaagtaaaaggaggccattggatgataggcatctcacacctatcatctcagcactttgggaggctgcggtgggaggattgcctgagcccaggagttccagatcaacctgggcaacatagaaagaccctatctctacaaaaaaaaaaaaaaaaaaaaaaaaaaaaatagccaggcgtggtgataggtacctatagtcctagctacttgggaggctgaggcaggaggattccttgagcccaggaatttgaggttgcagtgagcaatgactgagccactgcactccagtctgggcaacacacagaacaatcccttgtgtcttaaaacaaaacaaaacaaacaataacaacaacaacaaaaacaatggttcttgttaaacatacagcttcccaggttcccaggtacctctcctggagacagggattcagagggcctgagacgaacttgggaatttgcaagtttaacatacaccacgggaaatccttaccatcagagaagtcagagatactctgccaaggcaaagaagatgaagctggcagaattaattggccttccttgccgcttttccttaaatgcttgtctctgatttcctagttcctttagtgctggttctgtgccattgacacttgacctcatacatcctttcctgggttcctagcagctgctccagttcttgtctgtataccactctgcctcttgggtcacaaccgcttgccattttctactattaacgttgcattttgtttccgttgaatttgacccatgtgagagaactggcggttcagtacccaaacagatgatttccaccccagaagttcaaagaatgatatgatcttattttcttctttgttttggatatgagctaagcaaatgcattctaggtcagtggatgtcaaccttggctcagctcctcagggagctttacaaaccaccctgggtgattctgatgtcattgttctgggctatagcctgggatcagggactttaaaggccccagctgcctctaccatgccccatcggtggtagggtgtgggggtaccaacactctagaaagtcctgcaaccactctactagtttttaggagagtggaactgggtttataaaaaatgtttgctttaggtatagaatccatctgagctatctttgaaggaatcagccaaagtagcatattgctcacccaaactctcttttcaaggagagaaaaatcttcagtgagccccttttatgcctagccaccactcttccctggaccgcatctgagaagaacgttttataatatcgtatttatatagcgcttatctccctagagcacacataccatgcagatatgttttaagatctcattaatctcacagactttttcctttaagatttcacaggagtatcacggcaatatataaatgctgaaaacacaattttaaaaatatatataagtgccatgtaattttcaaactattatttacattccataaacatttatatttgggtgtatataaaacccggaaaatatctataacatatataaaacacaaaccatcaaatgtgcttgcattgatcaacatttcctttcaattccatcttttactctatggtaccctattttttctttctccttccctttgcaagaattttcatgtctctttattgctgaaattcctatggctacatttatggttatttcacccaccatgtttgcttattttccacatgctcatggtggcaatcgcatcaaggtgagcaaacggcttgcaacatccgttgcttcaaatcttaccatacaacccctccctgcctcacgcagcccatacaaattcttagctctgtggtattccttttcctttgacaattacttacaaactatgagtagctttatttgttgggcaataaaaaatggcaactgtgcctgcctgtatcaatttcaaaaggcagaatcctataggagttgaaaatatacacttaggagtcagagatctaggttgaaattctgtcatttccagaaagcgtatgacctttctgagcctctgttattgggatgtggtggggattaattgagataaccatgtattgtatggagggccatatctggggcatgatgatcaataaatgatgacgtccttagtagcatctgtcatctacacagacaagccttccagtctcagcccaagctctctcctttatttaagttgttcgctgactcctgctgggagacttcaagacccgtttcctctgctgcatcatttctttctttcttttttttaaaaaaaaacacaaaaaacttttacttctgggatacacgtgcagaatgtgcaggtttgttacataggtatacacatgccatggtggtttgctgcacccatcaactcgtcatctacattaggtatttctcctaatactatccctccccttgcccccacctcccaacaggccctggagtgcgatgttcccctccctgtgcccatatgttctcactgttcaactcctacttatcagtgagaacatgcggtgtttggttttctgttcctgtgttagtttgctgagaatgatggtttccagcttcatccatgtccctgcaaaggacatgaactcatgcttttttatggctgcataatattccatggtgtatatgcaccacattttcacattttctttatccagtctaacattgatgggcttttgggttggttccaattcttagctattgtgaatagtgctgcaataaacatacatgtgcatgtgtatttatagtagaatgatttataatcctttgggtacccagtaatgggattgctgggtcaaatggtatttctagttctagatccttgaggaatagccacactgtcttccacagtggttgaactaatttatactcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttatgtgcttttttgctgcataaatgtcttattttgagaagtgtctgttcatatcctttgcccacatttgatggggttgtttgttttttttttttgtaaatttgtttaagttccttatagattctggatattagctgtttgtcagatggatagattgcaaaaattttctcccattctgtaggttgcctgttcactctgatgatagtttcttttgctgtgcagaagctctttagtttaatcatatctcatttgtcaattttggcttttgttgccattacttttggtgttttagtcatgaagtccttgcccatgcctatatcctgaatggtattacttaggttttcttctagggtttttatggttttaggtcttatgtttaaatctttaatccatcttgagttaatttttgtataagttgtaaggaaggggtccagtttcagttttctgcatatagctagtgagttttcccaacaccatttattaaatagggaatcctttccccattgcttgtttttgtcggatttgttaaagatcagatggttgtagaagtgcggcattttttccaagtcctctgttctgttccattggtctatatatctgttttcataccagttccatgctgttttggttactctagccttgtagtatagtttgaagtcaggtagcgtgatgcctccagcttcatcctttttgcttaggattgtcttggctatacaggctcttttttggttccatatgaaatttaaagtagtttttttctgattctataaagaaggtcaatggtggcttgatgggaatagcattgaatctgtaaattacttgtggcagtatggccattttcacaatattggttctttctatccatgagcatggattggttttccatttgtttgtgtcctcttttatttccttgagcagtgattgtaattcccagaaagacggtcttcgtgtcccttgtaagttgtattcccaggtattttattctctttgtagaaattgggaatgggagtttgctcatgatttggctctctgtttgtctattattggtgtataggaatgcttgtgatttttgcacattaattttgtatcctgagactttgctgaagttgcttatgagcttaaggtgttttggggctaagacgatggggttttctaaatatacaataatgtgatctgcaaacagaaataatttgacttcctctcctcctgtttgaataccccttatttctttctcttgcctgattgcactggccagaacttccaatactatgttgaataggagtggtgatagagggcatccttgtcttgtgccagttttcaaagggaatgcttccagcttttgcccattcagtatgatattggctgtgggtttgtcataaatagctcttattattttgagatatgttccatcaatacctagtttattgagagtttttagcatgaaggggtgttgaattttatagaaggtcttttttgcatctattgagataatcatgtggttcttgttgttggtttggtttatttgatggattacgtttattgatttgcatatgttgaaccagacttgcatcccagggatgaagctgatttgattgtgatggataagctttttaacatgctgctggattcagtttgccagtattttattgaggattttcgcatcaatgttcattagggatattggcctgaaattttctttttcttggtggtagtctctgtatttcctgaatttgaatgttggcctgtcttgctgggttggggaggttctcctggataatatcctgaagagtgttttccaacttggttccattctccttgtcactttcaggtacaccaatcaaatgtaggttttgttgttgtgggaagtcagggaatccgaacggagggaccagctgaagccatggcagaacatcataaattgtcaagatttcatggacatttgttagttccccaaattaatacttttataatttcttatgcctgtctttactgccatctctgaacataaattgtgaagatttatggacatttatcacttccccaatcaatactcttataatttcctatgcctgtgtttactttaatctctcaatcctgtcatcttcataagctgaggatgtatgtcacctcaggaccctgtgatgattgcattatctgcaaaagttgtttgtaaagcgtgtgtgtttgaacaatatgaaatctggcaccttgaaaagaacaggataacagagattttcagggaacaagggagataaccataaattctgactgcctgcggggccgggaagaacagagtcatatttctcttctttcagaaagcgaataggagaaatattgcagaattcttttctcagcaacgaataacctgggaaaacgaatgcattcccagtaggaggtctctaaactggccgctctggatgtgtctgtcttatgcagttgtagataagggatgaaatatgccctggtctcctgcacacccccaggcttgttaggattgggaaattccagcctggtgaaattctagtcagactggttgtctgttctcaaacactgtttgtttcctgttaagatgtttatcaatgacaatgtgtgcccagtgggacatggaccttcatcagtaattctactttcaccctggccttgtgatctcactctgcctctctgcccttgtgatattttattgcctttgaagcatgtgatctctgtgacccactccctatttgtacacccctccccttttgaaaattgctaataaaaccttgctggttttgtagctcagggggcatcacggaacctgccgacatgtgatgtcacccctggagacccagctgtaaaatttctttcttttgtattctttctctttatttctcagaccggccgacacttagggaaaatagaaaagaacctatgttgaaatactgggggctggttcccccgatatttggtcttttcacataatcccatatttcttggagtctttgttccttttcattcttttttctctaatcttgttttcatgctttatttcattaagttgatcttcagtctctgatattctttcttctgcttcatcgatttgtctattgatacttgcatatgcttcatgaagttctcttgctgtgtttttcagctccatcaggccatttatgttcttctccaaactggttattctagttagcaattcctctaaccttttatcaaggttcttagcttccttgcattgaattagaacatgctcctttaggttggaggagtttgttattacccaccttctgaagcctacttctgtcaattgtcaaactcattctccatccagttttgttcccttgctggcaaggagttgtgatccattggaggagaagaggctttctgatttttggaattttcagcctttttgtgctgatttttcctcattgtcatggatttatctacctttggtgtttgctgttggtgaccttcagatggagtttttgtgtggtcgtcctttttgttgatgttgattctattgctttctgtttgttagtttgtattctaacagtcaggcccttcttctgcaggtctgctggagtttgctttaggtccactccagatcctatatgcctgggtatcagcagtggaggctgcagaacagcaaaaattgctgcctgcttcttcctctggaagcttcatcccagaggggcacccaccagatgccagccagagctctcctgtatgaagtgtctccccatctggagtcatggggatcagggacccacttgaggaggcagtctgtcccttagcagagctggagcactgtgctgggagatctgctgctctcttcagaacccgcgtgcaggaacatttaattctgctgaagctgctcccagagccaccctttccctcagggggtctctcccagggaggtgggagttttgtctttaagcccttgactggggctgctgcctttctttcagagaggccctgccccgagaggaggaatctagagatgcagtctggctacagaggctttggagagctgtggtgggctccgcccagtccgaacttcctgatggctttgtttacactgtgaggggaaaactgcctactcaagcctcagcaatggcggacactcctccccccaccaagcttgatcatccaaggtcgacttcagactgctgtgctggcagcaagaatttcaagccaatgatcttagcttgctgggctctgttggggtgagttctcctgagcaagaccatttggcttgctgacttcagccccctttccagggcagtgaaaggttctctctcgctggcattccaggccccactggggtatgaataaaaaactcctgcagctagctctgtgtctgcccaaatggccttgccgttttgttcttgaaacccagggcactagtgaaataggcatctgagggaatctcctggtctgagggttgcgaagaccatgggaaaggtatagtgtcttggccagaatgcactgcccctcatcacacagtatttcagggcttcccttggctaggtagggagttccccaaccccttgcacttcctgggtgaggcgatgccccaaccctgcttctgctcaccctgcttctgctccatgggttgcacccactgtctaaccagttccagtgagatgaaccaggtacctcagttggaaatgaagaaatcactcatctctgtgttggtctggctgggagctgcagactggagctgtttctatttggtcatcttgcccagaaatcctgctgcatcatttctgcttgtttatttcacctttacagatgttcctttattttcttttactagcatgtttctgcccattagactgtaaactccttggggcaggaatatgacttaaatcattttgtccctactcccagacatgcaagtatataatgagagtagggggacagatagggaacttcctacctgcagatacttggataattcacactaaggccttgaagaaaaattgcatgtctgcttctcctcctctccgcaagaagaaagcattagacaggcattcaagtccttagataccttttttctaactggtcctaaattggatctttaggcaaactttgcaaggtctgtctttgagaacggaaatctagaaaccctgtccatcgcacaaaattttggcatgctgaagcttaaattactgagcctccctagagaatgaggcttgttaagcttggggtgtagtttcccagaccgcactgctggaatctgcattctgggcacttggctccctcattttgattcaggctaattccaggggcaggtcaccttccccacagaggagcttggaaacacctgttatggacagacattgccgttcctcttcttctgaggagagaattgtttgatgtgtcttaaatgacctcattattagcccttggtggagcttccatttttttcagatttaaattggactaaacactgactaataaggctcctgtgcttattaaaattgtgttgttcatgttcatagcatttctcttcatcaccaaggaataatgagtagagtttgtaaattctttcgctaataattcagcaattatggtattaaaagagtgttttgtaggatagacatgagaggggatgtaaagaaattaggagagaggaactattcatcttgaagctgaaggggaatagacatttttgcctcccctcttggaacctaaatgaagtggggtaggcagaggggcctatgattgactttttgtctttatcaaggtataatttacaaatacaaattgtatgtatttatggtgcacaatgtgatgtttagatatatatattcattgtgaaatggttaaatgcttatcagtcaagctagttaatgtagccaacacctcacaaagtttgttttttttgtgatgagaatattcaagatctctgatagcaattttcaagtataaaatacattattattaactataggcaccttgaagtacaagttctccagaacttactcatactgtctaactgaaactttgtaccatttgaccaacagctttttgtccatttccttttccaattccctcagcctctggtaatcaacctttgactgactgcttctatgagttagaagttttttagattccacatataagtgagaccatgtagtatttatatttatatgcacagcttatttcagttagcataatatcctctaggttcatcctgagttggaggatttccctgttttctaaggatgagtactatttcattgtatgtatgtatgggtcacattttctttatccattcatctctccatggacacttagattgattctgtatcctggctattgtgagtagtgctgtactgaatatgggagggcagagatctcttggacatactgatgtcatttctgttggatatgtacccagaagggggattgctggatcatagggtagttcattgtagtattttttgaagctccatattgttttctaggatgccggtaccaatttgcttgccaccaacagtatacaaagggtatttttccttacacactctccaatacttgttatattttgtctttttgttcaaaactattctcactggtatgaggtgatatctcattgtcattttaacttgcgtttcccagatgattagtgaagttgaacttttttttatctatctgttggccatttgtatgtcttcttttgagaaatgtctatttaggtccttttgccatttaaaaaatcaggttacttgtttcttgctattggtttgaattccttatatattttggatgttagccccttacagatgtatggtatataaatatattcccccattctgtaggttgttctttcattctgtcagatgtttcctctgctgtgcagaagcattttagtatgacacaattccatttgcccatttttgcttttattgcctgtgctttagagatcgtagccaagcatcatggtccagactaatgttaataagtttttgcctatgtttccttctaatagttttacaattttggatctggattttaagtgattaatttatttcgaattgactttgtatataatgtgagatacaggtccaattttattcttttgcatgtgactatctagttttttcaaaatcaattactgaagaggctgtccttccaccattgtctgtccttggcactgttgttgatcagttgattgtaattgcatggattaatttctaagatctctattgtgtttcattggtctgtatgtctatttttatgctggtaccattctgttttaatttctacaagttcgtggtatgctttgttctttatgctcaagattgttttgaccagtcagtgtcttttgtggttccatatgtattttatgattgctttttctacttctatgaaaaataccattgtaattttgagagggatggcattgaagttgtagatcacttgtagcatggacattttagcaatattaactttttcaattcttaaacatgagacgtcttcccatttatttgtgtcgtcttaaatttctttcatcagtgttttatagtttcagtgtacacatctttcagctcagttaaatgcatttctaagtgtttttttaatgctattgtaaatgggattgtttgattgattttggggggatagttctttgttagtgtatagaaattttactgatttttgtgtgctaattatgtgtcttgcagcattactgaatttgtttattagttccaacagtgttttggtggagtctttaggattttctatatctaaaattatgtcacctgcaagcagagataattttacttattccttttcaatttttatgccttttatttccttttcttgccaaattgcccttgttaggacttccagtactatactgaataggagtagtgagagagggcatccttgccttcttcctgatctaagaggaaaatctttcacttttttaccactgaatataatgttagttgtgggattgacataaatggccttttaaatattatatatgacctttttaatattaagatagttttcttctacatctaattggttgactggttctatcatgaaagcatgttgaattttgtcaaatgctttttctgcatctattgagacagtcatatgattttcatccttcattctattaagatggtgtataacatttattgatttgtatatgatgaaccatctttgtatctcagggacaaattccacttgatctcagtgtttgactgtttcaatgtgctgttaaattcactttgtttgtattttgtgagaatttttgtatctgttaatcaaggatattggcctatagtttttttttttttttttatagcttcctcatctggctttgctatcagatcaacactggcctcgtaaaatgaatttggaagcattcactcctcttcaatttttttgtatgtgattgatatttaaatcacatttctaatatttggtgaggacagagtattacagtggtgttggcttctctttgtaaattttccctctttagggcattccagtgcttctatattcaaagtaaaatgtgcactaatgtgaaaaatagaggaaattctatttttaaaactgagggtcattttaagggtgatgtagtaggtcgaatggtgacctccaaaaagatattggcatgtcttgaccataggaacccacgaatatgatcttgttttgaaagacaatgttggcaaatgtcactaagttaaagatctcaaaatgagattaccctagtttatctgagtaaaccataaatccaatgacaagtgtgcttataagacacacaagagaggacacacaaagaagaaggtcatgtgaagacagaaccactgactggtgtgatgcagccatgagccaaggaaagcctggagtcaccaggagctggcagcagcaaggtaggatcctcccctagagagtttggaaggaggctggtattgctgacaccttgatttcagacttatgacctccagaagtgtgagagaatacatttctgttatcaccaagtttgtggtaatttgttccagcagccccaggaaactagtccagatgactagaggattcatatcagaaagacaaagtgacaaagttcatgggctttggtgattacaagacctggttaaggttcaggcatttttactcctttgcttctatggccttaggctaagatatcctctccgacatctgattggccagtgaattgacaattcattaattggttcctcaacaagcttataattacatctttgtgtgctctagtcacagtggtaggcattgtggtaagtagatgcacttcctaacattatacaattttacaggtaatgcaaagagaccagtattacagtatgtttgttaaatgttctttaatctgactataaatattgcaactggagaacatgctaattggagaacatttaaaaaatataggcaaaaataatagaatagattgggcgccacggctcacgcctgtaatcccagtattttgggaggctgagatgggtggatcacctgaggtcaggagttcaagaccagcctggccaacatgatgaagccccgtctctactaaaaatacaaaaattagccaggtgtgatggcacaggcctgtaatcccagctacttgggaggctgaggcagaagaattgcttgagcccaaaaggcaaaggttgcagtgagccgagattgcaccactgcactctagtctggatgacagagcaagatttccatctcaaaaaacaaaaaacagaacaataaaataacccattagcccagaatcaaagtttaatcacagttaatattttaatggatttctttcaatccattttataaatattcttataactacaatagtatatattactttaacattagattaaatgaaatgttactttaaaatatcattataatgcctttataagtcctttatagagaatactgttctctaattttgtagcatttaggtttcatcccaatttctcctatgcacaaaaatataggtttgggtactggattttgttctaggaacccagaatgggaccctgatccagtctagatggctttccagggaaggactgaatgtgataggaagagtgaggccccctcccagggccattctaagtattcaaggagataatgcaggtgaaaaattattggtcagttgttaggaaaatttttctctattgatctttttttatctattagctttgatttccagtaaatacaaattaaagtaaaaaagaaaagcacaaagaagaaaatcaaattgcctagagttttatttctgtcagttaataactgttaatattttagggtataaagtttcatcattttctatgtgtatgtagtgtgtatatttttttctatttgttttttttaaaaaaggtcatgtgtacatactttgtgttaatgtatgtattttcttcatatcaaaactattctgagacagtatttcaatgactacatagaaggcattttatcataggactggaaaacaatttatttgatcttaataatttttccaaattgtgatgcttatgtttatggcatgactatgctgtttttggaattttagttccttctagtgttgcactgttgccaacgtttgcctatatcattgattattaactcggtattaattcccataatggagtggctggattgagcctctggaaattttccttgtttttgataaattgtgccaaattttcctttggaaaattgtgtggacttgaacttctacatgtagtgggctggaaaacccccacctagatgactggtctgaatttcataagaatgaatatgtgttgctggactcaagtaataaaattgcactgtttggtatttatttttaatgagtagattttggctgattttgacacacacaaaaaatgagtaactagattgggaggttccaagatggccaaataggaatagctcaagtctacagctcccagtgtgagtgacgcagaagacaggtgatttctgcatttccaactgaggtaccgggttcatctcactggggcttgtcggacggtgggtgcaggagagtggatgcagccaactgagtgtcagccgaagaagggcaaggcattgcctcatccaggaggtacaaggggtcaaggaattccctttcctagctaagtgaagctgtgacagatggcacctggaaaatcaggtcactcccacactaatactgcgcttttccaatggtcttagcaagtggcacaccaggaaattatatcccgtgcctggctcagagggtcccacacccacggagcctcactcattgccagcacagcagtctgagatcgaactgcaaggcggcagcaagcctgatggaggggcacccaccattgctgaggcttgagtaggtaaacaaagctgccaggaagctcgaactgggtggagcccactgcagctcaaggaggcctgcctgcgtctgtaggctccacctctgggggcagggcatagccaaacaaaaggcagcagaaacctctgcagacttaaatgtccctgtctgacagctttgaagacagtagtggttctcccagcatggaggttgagacctgagaacggacagactgcctcctcaagtgggtccctgatccttgagtagcctaactgggaggcaccccccagtaggggcagactgacacctcacatggccaggtacccctctgagacgaagctttcagaggaatgatcaggcagcaacatttgctgttcagcaatattcgctgttctgcagcctctgctgctaatacccaggcaaaagggtctggagtggacctccggcaaactccaacagacctgcagctgagggtcctgaatgttagaaggaaaactaataaacagaaaggacatctacaccaaaaccccatctgtacgtcaccatcttcaaagaccaaaggcagataaaaccacaaaagtggggaaaaaacagagcagaaaagctgaaaattctaaaaatcagagtgcctctccccctccaaaggaacgcgactcattgccagcaacggaacaaagatggacagagaatgactttgacgcgctgagagaagaaggcttcagacgattaaacttctccaagctaaagaaggaagttcgaacccactgcaaagaagctaaaaaccttgaaaaaagattagaagaatggctaactagaataaccagtgtagagaagtccttaaatgacctgatggagctgaaaaccatgacacgagaactatgtgatgaatgcacaagcttcagtaggcaattcgatcaactggaagaaagggtatcagtgattgaagatcaaatgaatgaaaagaagtgagaagagaagtttagagaaaaaagagtaaaaagaaatgcaaaaagcctccaagaaatacgagactatgtgaaaagaccaaatctacgtctgattggtttacctgaaagtgatgcggagaatggaaccaagttggaaaacactcggcaggatattatccaggagaacttccccaacctagcaaggcaggccaacattcaaattcaggaaatacagagaatgccacaaagatactcatcaagaagagcaacttcaagacacataattgtcagattcaccaaagttgaaatgaaggaaaaaatgttaagggcagccagaaagaaaggtcgggttacccacaaagggaagcccatcagactaacagcggatctctcagcagaaactctacaagccagaagagagtgggggccaatatttaacattcttaaagaaacgaattttcaacccagaatttcatatccagccaaactaagcttcataaatgaaggagaaggagaaataaaatcctttacagacaagcaaatgctgagagattttgtcaccaccaggcctgccttacaagagctcctgaaggaagtactaaatatggaaaggaacaaccagtaccagccactgcaaaaacgtgctaaattgtaaagaccatcgatgctaggaagaaactgcatcaactaatgagcaaaataaccagctaacatcataatgacaggatcaaattcacacctaacaatattaaccttaaatgtaaatgggctaaatgctccaattaaaagacacagactggcaaattggataaagaatcaaaacccatcagtgtgctgtattcaggagacccatctcaagtgcagagacacacataggctcaaaataaaggggtggagaaagatctaccaagaaaatggaaaacaaaaaaaggcaggggttgcaatcctagtctctaataaaacagactttaaaccaacaaagatcaaaagagacaaagaaggccattacataatggtaaagggatcaattcaacaagaagagctaaccatcctaaatatatatgcacccaatacaggagcacccagattcataaagcaagtccttagagacctacaaagagacttagactcccacacaataataatgggagaatttaacaccctactgtcaacatgagacagatgaatgagacagaaagttaacaaggatatccaggaattgaactcagctctgcaccaagcagacctaatagacatctacggaactctccaccccaaatcaacagaatatacattcttctcagcaccacattgcacttattccaaaattgaccacatagttggaagtaaagcactcctcagcaaaagtaaaagaacagaaattataacaaagtgtctctcagaccacagtgcaatcaaactagaactcaggattaagaaactcactcaaaactgctccactacatggaaactgaacaacctgctcctgaatgactactggttacataatgaaatgaaggcagaaaaaaagatgttctttgaaaccaatgagaacaaacacacaacataccagaatctctgggacacatttaaagcagtgtgtagagggaaatttatagcactcaatgcccacaagagaaagcaggaaagatctaaaactgacaccctaacatcacaattgaaagaactagagaagcaagagcaaacacattcaaaagctagcagaaggcaagaaataactaagatcagagtagaactgaaggagatagagacacaaaaaaacccttcaaaaaatcaatgaatccaggagctggttttttgaaagatcaacaaaattgatagactgctagcaagactgataaagaagaaaagagagaagaatcaaatagacgcaataaaaaatgataaaggggatatcaccaccgattccacagaaatacaaactaccatcagagaatactataaacacctctacgcaaataaagtagaaaatctagaagaaatggataaattcctgggcacatacaccctcccaagactaaaccaggaagaagttgaatctctgaatagaccaataacaggctctgaaattgaggcaataattaattgcttaccaaccaaaaaaagttcaggaccagatgtattcacagccaaattctaccagaggtacaacgaggagctggtaacattccttctgaaactattccaattaacagaaaaagagggaattctccctaactcattttatgaggccagcatcgttctgagaccaaagcctggcagagacacaacaaaaaaagagaattttagatcaatatccctgatgaacattgatgcaaaaatcctcaataaaatactggcaaaccaaatccagcagcacatcaaaaagcttatccaccatgatcaagtgggcttcatccctgggatgcaaggctgattcaacatacgcaaatcaagaaacataatccagcatataaacagaatgaaagacaaaacccacatgattatctcaatagatgcaaaaaggcctttgacaaaattcaacagcccttcatgctaaaaactctcaataaattaggtactgaagggacgtatctcaaaataataagagctatttatgacaaacccacagccaatatcatactgaatgggcaaaaactggaagcattccctttgaaaacgggcacaagacagagatgccctctctcaccacccctactgaacatagtgttggaagttctgaccagggcaatcaggcaggagaaagaaataaagggtattcaattaggaaaagaagaagtcaaattgttgctgtttgcagatgacatgattgtatatttagaaaaccccattgtctcagcccgaaatctccttaagctgataagcaacttcagcaaagtctcaggatacaaaatcaatgtgcaaaaatcacaaacattcttatacaccaataagagaaaaacggagaggcaaatcatgagtgaactgccattcacaattgcttcgaagagaataaaatacctaggaatccaacttacaagggatgtgaaggacctcttcagggagaactacaaaccactgctcaacaaaataaaagaggacacaaacaaatggaagaacattccatgctcatggataggaagaatcaatatcatgaaaatggccatactgcccagggtaatttatagattcaatgccatccccatcaagctaccaatgactttcttcacagaattggaaaaaactactttaaagttcatatggaaccaaaaaagaacccacattgccaagacaatcctaagccaaaagaacaaagctggaggcatctcactacctgacttcaaactctactacaaggctacagtaaccaaaacagcacgatactggtaccaaaacagagatatagaccaatggaacacaacagagcactcagaaagaataccacacatctacaaccatctgatctttgacaaacctgacaaaagcaagaaatggggaaaggattccctgtttaataaatggtgctgggaaaactggctagccacatgtagaaagctgaaactggatccttccttacaccttatacaaaaatcaattcaagatggattaaagccttaaatgttagacctaaaaccataaaaaccctagaagaaaacctaggcaataccattcaggacataggcatgggcaaggacttcctgtctaaaacaccaaaagcaatggcaacaaaagccaaaattgacaaatgagatctaattaaactaaagagcttctgcacagcagaagaaacaaccatcagagtgaacaggcaacctacagaatgggagaaaaattttgcaatctactcatctgacaaagggctaatatccagaatctacaatgaactcaaacaaatttagaagaagaaaaacaacgccatcaacaagtgggcaaaggatatgaacagacacttctcaaaagaagacatttatgccaccaacagacacatgaaaaaatgctcatcatcactggccatcagaaaaatgcaaatcaaaaccacaatgagataccatctcccaccagttagaatggtgatcattaaaaagtcaggaaacaacaggtgctggagaggatgtggagaaataggaacacttttaccctgttttacaggtggcactgtaaactagttcaaccattgtggaagacagtgtggcgattcttcaaggacctagaactagaaataccatttgacccagccatcccattactgggtatatacccaaaagattataaatcatgctgctataaagacacatgcacacgtatgtttattgcggcactattcacaatagcaaagacttggaaccaacccaaatgtccaaaaatgatagactggattaagaaaatgtggcacatatacaccatggaatactatgcagccataaaaaaggatgaattcatatcctttgtagggacatggatgaagctggaaaccatcattctcagcaaactatcgcaaggacaaaaaaaccaaacaccacatgttctcactcataggtgggaattgaacaatgagaacacttgagcacaggaaggggaacatcacacactggggcctgttgtggggtggggagaggggggagggatagcattaggaaatatacctaatgtaaatgacaagttaatgtgtgtagcacaccaacatggcacatgtaacaaacctgcacgttgtgcacatgcaccctaggacttaaagtataataataaaaaagagtaactatgtgaagtgatgaatatattaatttgcttcagtatgataaccttttttaccatctatatgtatcccataacatcatattgtatactgtaaatgtacacaatttaaaaaaagttttactaattttcaaagcactcaaagttcatttttttctcttaaatgcttatgttagagttcaggtttgtggctatttttgtcatgctaatggaaattagtggtgaaaaatcttatcaagggaaattgcaccagaaatgagtcaattaaattctattttataaacattcattgaacatcaatcatgaggataagagtttatttgaatctagtactatgaaaagatgaatgtgatgtcatccttttaaaaagtacacagtgttacagaggaataaaacctacaaatgcctatgaataaatatatatacatatgagagggaagaatgtaatatatactgtcatacagactcaagcagaaaggaagataagatcatgttttcttggaaggtatggcaaagagattgccctctgaggctaggcaggattttaagagatggagattataaggccataggaacagcatgaagaaagcacataaggtcagaaaggctaagaatatttaggcaatggtgagcattctagtctggttgaagcctaggaagtatgtgaagggttttgatcatcatgctaagaacttggaagcttattccaatagcaaaagtactacttggatattcttgacatgttttttctcctgccatttaaggctggtgactattttcaatgggtaggatttatcagttaagagggaggtagcagaacaaaagaggaagaagaggaataaaatctttcccatgaaatgcaacttgaacataacagttgaaggacaatgagagcaaaaaaaaaaaaaaaaaagtcatttttctgtctcattggcttgccatgtttagaggatttcttgagggtttcttggcaataaggatattgagtacctactatgtgctagatgctttcctaagctttccttgaacaatttaggtagatattttaaaccagtttatgaaaaaggaagtcaaagtctattaagttcatgtcccttgttctggatcacacaaagggctgggaataaaatttaaatcagttgcttccagatcccatgctcttactactgccctgtattgaatatgtgaccttctgggagcaggactttctgcgttcttttattattcttatagcttctatctctgaatcctaagacatgttgagcttgggttggaatatgcaatgaatgcatattaataattttccaaattgtggtgcttatgtttatggcacgactatcctgtttttggaattttacttgcttccagttttccagtcttaagaacagcagtgtcatgaactgttgcactgttgccaatcttttcctatatcattgattatttattcagtattaattcctataatggaatggtaactcagaattacctgttttgcactttattttcttcagattctgccaaatcatcatcttagaactagacagaactttggcggtcacctggtttgttgttcacccttctgaaatcccaatatagcatctctgatagatattgtctgactcaagacttgactgcagtagaaggggttgtgttttactcaaatgactcatttaatatagctgagaagtggaatgacagagggaaagccatgtttgcttctagagaggttaaacattgaacagaaaaagtaatgtatagatgctgccagagataagtccagtagtctgctgtgttgttcccagccttactcatcgttcacagcttaggaactcctctgcaaaggagacagaagcaatgtgttcctgacttataactgtgatgagttaacctacttttgtaatatatttataatccttttgagctccttggaggaaagatgcaatatgaatataaaataataacaaggctagccttcaagtacttcctgaatgctcaggtgtagtttgaggcttaatgaatttgggttagtaaaatattctgagatcccagctgaagggagctagagagcacaaatggttattaattattgttattattgactcttgcccagagcatggagatggatggcctctgccatgctttatccccaggagtgtagctgcagatgccagtccagtgtgccataaatgtctaatcttttagaaggattaactctactttggattaaaaaaataatgatttcccataatctattctgaatgagatgcttttttctcctcctatttcatctggtgactttcgatacctataattgaaacaaactgcactgaaaccctggctggacccttcatgttttatattaagaagcagtgtgaagaccgtctacttgaattaatctcacctgcataacatgaggagaggaaacaaatgaaatgtagttttacatgtaaccttggcatatttcacctactttgtgtcttgtagtcatgttcttgccacccagaatgtccaaactgggtctatacacagtcaacatagatcagatttttttttcaatcattttgctttacatgatcttaatcattccaacaaaagcttcatcagccaagcaaagtatgtctcattatgtcagatgaaggatgacaaggttcataaatttggaaaggagagctgtatttctcataaagagttactgtctgcaggggggccattctgacaggctgggaaacatagcctccagtcagaagccagaaacagacacttcaagggagaagaaaagggaacaaaaattatgctgagaggggtggctgaatatacgtatttataagctagaggaggagtcatgaatatgtataaaaggagaaacatgtatatgctcaactgagctgcatgcctctccatggggcccatgttcaaaatatggcggcattggcatgatctgagggtgcagttttcagtcctctgacataaaaatgtgaagcagagaacatgaaaaccctcactgtacatcctctgtagactggccagaaccacttcatggttgatggtctcttatcagcaaggaatgctagttggtagttgggctgaaactgcaaaagagaggggcagtttaaggtggttggtgtcaggggtttggttgatatcgatggtggagccagtctttccaaaggtctggtttatttaacccctaggaaaaaatgcctaatggcagttagcgagggaggaggtataatgaggcttgtctgacctcccatcccatcatggccaggaactcatattctgaggtttctctgcagttcctcttgaccaagagggtgtcccttcagtccattagggagcttaaaattttatttttatttttcattcagtttcaggcttgctccaaggaggcagggggaaaagttgatgattacttaactctgccccaatcactgtctattgtcattgcctgagaaacacaatggaaagatttgggtagatgaaatggttcaagcacatttccaaagtgattacagaaaagtttcattggtttttgagacacaaacatttagctgttaaaataaacaaacttctgcatccctacaattattgcttaccaatgcagatgcagcttaaatgaatcccagctcatcttgaatactgttatgatctcctcaaatgaagcttcttgctattttagccagggagggagcagtcagtattcagctgaatgatcttgtgacaatatcctccctgttttccagttcaagtttgaaggacatttccaatcaggttaatgaagacctgctgctttagtgctgaaataggtttgtttacatctctcctcttatctatccgtgaagagccattctttttcatctgccagccaatcacagcctgccagtgcaacatctggcttgagcagctgctgaaagaggaagtatactttctctcccctcaagcaagtaacaagtgtgtgtaattgagaacctgtaattgcaagaaggcacagactttgggagaaaccatgaggggaaggctgatagaggagatgaatgaagcaaggcaggttttgtacactttggagggagtgtgaggtggaaagaactgcacagaggagggcagcgaatcatttttatttgtgcaccagcagagaggagttattgtaacatgtgttcataatgtcctgggccactttttaatcagatgaacataaagaaaaaacagataaaccttaatattttcccaaattgaaaatgcaagggatcagttatgaatctgagtggtttttgattatgtgactaagaccctcttgagcccaaaggtattctttaaggaagcatgtgttaaaatagaaacaggctggcttcttccacgtttcggtgcatttagttcgcctaagcttgagtactctctcacccttggcacactgaaatactactgcctgagtaggaaatgcatttaaaagagagcctattatcaattgattccatgtcttatcaagaaattccaaagcatctctttcctctattggggtctgtttccttccaaatctgcagctgtattgttcgactgagatgaattctagagaactgctatgagaactttttcaaaactttacatcaggccagatcagaatcactggaggtgactgaaaaacacttgaaatagtttcccggattgttccactctgttttaccttttctacatgccccactttacttagaatacttcactgtatttaagagttcccacttgctagtgctttgtaaagattttggaaaactatctttgaaccttagtcatctttgagaactccttgcagagagaagagcagagcacatccagccaaacaaagcagcatctcaatccctgaacagtctaaatgccaccagaacaggcgggaatagaagatctgctaagccgtcgctacttcaagtgtggtctgtgggccagtatcactggcattacctggagtttgttagaaatgcacaatctcaggcctcgtgccaaacctgtgaaattcaaatctgcattttaccagaatcttcagtgatcttcgtgcaaagtttgaagagtgctgctcaaagccacatctgaataaagaaaagactttaagagccaataccagcagagttccacccatgatttttcactgcttatatatgaacaactatacttattttaatacatgtgcaggatcaaacaaatcctttctgtcaagggcttatagtaaatattttaagttttgcagctacacagtctctgatgaaactttaactctgctgttatagtacagaagcagccacagacaataactaaaaaaatgggtatggctatgttacaataaaactgtatttatgtacactgaattttaaattttacataattttcatatgacgcaaaatatacatctgatttctgctcacccttgtaaaaatgtaaaaattattctcagctcatgggctatacaaaagcagatgatgggtcagatgtggcctgtggaccgtagtttgcaaactcctaaaacatattgagatgtgtttaatttttattctgtgttgcagaggtattcattcaaaatttattcttattctgatccaggtggcctgcagaaatacccttgacaaatcctggtccaaaggtttaaactttgaaatcacacccaaagctcttcacaaaccttgaccacatctctcctttccttctcctcctctttttaaacccaatacattagacactcagaaaggcaggattgcagagcagctaagaggctgagcattggcatcacctgtatctgggttgacacttaggttcttctgtttacgatgtgaaccttagtcacgatacttaacctctgcacagcttagtctcctcatcattaatttggagataattatataatggctggctgacagttttgtgctatttgtaaaataacgatcaagtatgcagggttcttagcacaatgtttggcacatgacaaattctctataaggcttcatgattcctgatccatgctgtgaatatttagctctcgatttcttggcttacgatccttttgcccagtttacctttccctcgtttgtcccttctatttccatattcttctaggttcaggatataagtccctcctcttctaaaatctttcctaactcatcccactgtgccaatccctacttaggcaaaagtaatgattccatgcttttgctttgtgaatcacatcactacatttgctgtcacattttagcatggtcatgtgtatatttgcctcactggctggacgttgggatctgtctgatttggttttaaaacccaggcacctgggcacagtccatttcccagagcaggcaagcaacagctgcatgaattaaagagatacatgcagtagttgtcatgagtaaagaacttgagaattgtgatgaaattacctttattatagtacagactttttattataattttaatttctcaacctcattgctataagtgagatattgaccaatacagtgaatctccatgtgtcttttggagctcaaatcctccctctctctttttatgtctccctgcttatggacacttgggtctcagctgtgcccatctacatgcatttgccctactcctgcctatgcacttttattcgacttggacctctgtacatggattcctgatgagtggccgagttcccagcttgagtcttggatgccaaccctgcatgtgtagctttccagcttctcctctttctgtaacccgctggatgcttatcctcttttcatttcagcccataggtgtccaacggtgccgcacgctccttgctataaaactggccaggatctgtagctgcccaatattctcaggttctaaccatcctgccagcccttgggcttgccagctctttttggtttcagtctttcctgaccttccagaactgtcaccggagagcattttataatcaggaataaagggatggcaaagtcaggtcacaaggagatggccacagggtgcagcgttcatccagaaacaagctcagtccgcatgaaaacttctctcttcctattgtaactctttgcttgaaaaaggagcttcatcctccaagggcagctgcaccccagcccatggaagatgaagtgaagccctaatcctgtgttgctaaaagtgctgtggactccttgccaatgtgcagaacgatggtgaaaatagtaattaataagtgatggggtattattgactcatcaggaacacctttgtagtaggctggatcaatgcataatatgggtctcataaagatgcttcttagaaatgcagatacttctggtaatgaaacgagctaaaaatttgaaaaggccccctgacttttttttttttaaaggaaagtagcttcaatctaaaggagaatgaaagctcatttggcaaggaggccgagaccagtgccagacagcaagcttaatgcatttagtttgcccctaaatcccatctattaaggaatcaactgcatgattaatattatttttctttcagttgtccaacaacgctgcactgaatgttgaatattgaattcatattttctctaagcagccgaacatatttatttggaattaagtctctgagttggtgactttgggaaagcctgggaaaccagaagcctgcataatggaacatcgctgagagaacactggtctgcagggcatgcctgttttatatcggggatgctcaaacatgtctggatgagtttcaagttcccctcctttgctttcttctcaatgagtggggtttacctggtcaaagcaaacaataagagcactaaacatcattaactcatcctgaacttttctactcagccccaaatttggtttccagtcatattggcccacagttttagtcatggtgtttcagctaaataacagctggaagttgatggcaacccagctgtagcctgctagagcaaacacttgagctcctatatgtataaaaatgataaaatggctagacgtataggtctctaattgcagccaggattctgcagctgggaagtcacccgaagatatgtattctgtgttgtaacccagcaactatgcattccatcccaactgaaaagcatttcccttccttcttacccccgagattgctgccaaaatgtgaagtccagttccagctcccaaactatgtttgcttctcattaggagctgacccagctccagtcttgtaaatctagccatggattgagccagggagatagatcagttagagtttgagggtgacgtgatggtaaggtagtaccaggacattagactcagatgcggtcctaagataaaatctatggggtcacaaaggcagccctccaatccagcaccacctgcaccaccatacacatgattgggagcagagcctcttgtttcctcccttcagccttctgacacatcccctcactccctgcctcccctcttctacgttcctcttttccattcctccctacatatatacatacctgtcctccttgcttcaaacagctcctacaactcatcgcccctctctaccgggccctttccaatgatggggaaatgttcatcttccttgaacttctctcacaagcattaaagggctttcctcttcctttgcagaaggaatttccctatagtcaaatattcattcttctgtctttacaattaatccaccaagcattgctcttgataggaaaaaaaaaatcaaatttagttttcttctgcttgaagtctggctttcaagactatcattttattgtggatttaaagagctgagcaatgatttctttgttcccttatcctgaggtactgatctttagcttcttggactaactagtcttcatagcagaagggctgcaggagctaaggggagaagatattaataaaagaggccaagaaaggaaagtatatctgcaagagtctaaaccattatttggctacagtgataagccctggcactgcactgccctggcatctttgcctttgggactagaccaaaatctccttatgataaggagccttccatttgcttttatatttgcagggtcttgcacagtgcctggcataaaaatatgcctaggcaatgaacagtgtgaatgaatgaatgaactgtcaaatctgtttggatctgcttgcgctaatgatagtgccctatatttgtaaaattttcccaagtatttccacatatatcatctgacttgatgtgactattggtaagttgtcatttttttcctgcacttctgtcaatgagccagaaaacatataaataagcaactaatttaattctgagaataaaaccagaaggagcaatggcatagatgatgagatatattatcttctatctggcattcgggtctatatcaggggtcagtaaactgtggcccacgaaccaaatctgtcctatcccctattttggtaaataaagttttgtcagaacacagccatacttgttcatgttgctgctttatcttgacaatagcggagctaactagttgtgagagatggtcaggcctgtaaagcccaagacatttgcgattttgcccttgactgaaaaagtttgctgacctctggtctagatgattaagagacattcgttcagcagggggcacatctcactttttaggatgccaagaaagctagagaaagtctgcctgcctttgaaactcttcttgatagctgggtggtattttctgatcagtgaccaaagttatgtgcttaaaaagaaacagcaggcaggaaaagtggagcagtatataaaacataaaattatcctcttcagtggatgcatgggtaaaggcatactggagtacccaggatttcacactcaggttgccttgtgttacctcaaacagctcaacataaagtgcttcggagggcccattttcccacaaggcagctatgacgtcccgctgagccatcttagccttcttccttatctcgtactttctgttatctttacacttgagaagttactccagatgcagctctgctgaaagtaacataattaggtatgggtccctccccttgctctttcatcatccctgcagtgtgtgcacgctgccttcactctgagagcttaatttttccctgctggatccataagtagatggaacatatgggacctcttgtacctgtaggcattttagcaatttcctctgatgaatccatttgtaaacctctgctcgttagaacgaaaggttcctcttgtttttgcagcctctgaagattttgtcattcacacgggcaggaggtcatgagatatctggttagttgtggggaaatttttgcttttggatgcttatttactttgataagttgagattatttttttttacaggcagttacttttaatttgtctgcatgacaataccaatgttctagaacaagtccaacatgaggatttgcaatctgcctctttatcttggcagctgccatttagccttgctgtttttatcactgagctatagattaggaaaccgaatgcaaactggttaagtgacttcatgattaaagtgaagtcatgcaaataaagagaatactgaaatattgtttctcagtggcacctgctgtattaaaacaacatagacttagaaataagagaatgtggattccagccacatctcccaccacttaacagattccaagtctcttgccaatttgttctgtaacttctgtgagcttcagtctcttcctctaggaaatctagatgatgattgtatcaccagcctcactaaattcacttctattccatttctactgacagaattttattgagcatttactctttctaggctctttgtctagcactgtggttatacaaaaatatatttatttctccttaagtggctagggtgaattgagaagtcagacacatataagaacgagttctatataatttggtatggagcatgtgggattctatgtgagttttacagggatacagaagagggtatttttctcagtctgagggtccagggaaattagtgtcattaagccagggtagaagagaagggttatccagatggggaccatagcatgacaggaagcaagggtgtgcgaaacagcatggtatatgtggaaagtcccaaaatgtttggcagtatttggtcataaagagaaaagcatacggtggcagcctatgtggctggaggtgcatgtgaggaccaggtcatgagaggccttgtaggccttgctaagggatcctttctgactctatccagagagctctgggaattctgtgaggctttcaggcagggatgtggtacagcaattacagtgcacttttgatcactttggctagtgtataaggcactagtccaacagaagagagttttaaagttaagagataattcttacagcttccaggaaagagacagactagatctgtgacagaagggacagaaagaaagggtatggtttttagaatcagtaaagaaatcattaggggtagagaggttgattggatagggtgggtgaagaagaggggatatgtttaaactgatgattaaacaagccattatgagtaaaagcattgcacaaactctaaagcactggaaaaaaattaatgatatttttagtcattcttcagaatatatttagtgatgttatgctcagttttaagccctagctaagttctggctgtgtgtggggggtggggggcgtggagcatagtgaaagaatgggagtacagaaaatagaagggaaattatatttataaaaaatgttattccagacactggcctaatactacacattcatgatttatcttggttctcacaatagcccttgaaagttgattttaccttcatttttggatgagagatggagacttaaagataacacaatccctaccctcaaagtgctcctagaatagtgagggaaatttgtataaattgaattataactcattatgagtgaagctatgatgaagatgaacatggagtgatgcaagcatatagaagaaaagtgctgacctatatttagggaaacttctcagaggtggtagcatctgtaaggtgattgagacttgtccacgaagtaggagggggcagcccacggagtcacatgttcaaaatttgaaggactatgaacagagaactgcaaatggatcagtatggctcataggagtagcaaagggaggccaaggtgggtggatcacttgaggtcaggagttcaagaccagtgtggccaacatggtgaaacctcatccctactaaaaatacaaaaattagctgggtgtggtgatgtgcatctgtaatcccagctacatgggaagctgaggcaggagaattgcttgaaactgggaggcggaggttgcagtgagctgagatcacaccactggactccagcctgggtgaaagagcgagactctatcaaaaaaaagaaaaaaaaaaaaagaaaaaaaaagaaagtgaaactgtaggatatgctaggactgggccttatgataaaagaaataggaaaccattgatgagttttaagcaagtgtgtgttaagataaaataaatacttaagaaagattattttgagggtagtgtagaagggaagaagaagatcagggaaaggcaatttcaaggtcataggaggtagaagcttgaagtagtatggtaaaagtggagatgcggtaggactaacattcaggaggtgaagagagacaacatggtgatcaggggttttagaaagagatagatataggccaggattataggctcacgcctgtaatcccagcactttgggagactgaggtgggcagatcacgaggtcaagagatccagaccatcctggccgaaggccaacatggcgaaacctcacctctactaaaaatacaaaaattagctgggcatggtggtgcacacctgtagtcccagctactcaggaggctgaggcaggagaattacttgaacctggaagggggaggttgcagtgagctgagatcatgccactgcactccagcctggtgacagagtgagactctgcctcagaaacaaacaaacaaacaaacaaaaacacatacaaaaaaacattcaggaggtaaagagagacaacacggtgatcacgtgttttagaaagagatggatataaatgccactcactttcttgtttgggggctgggtagatggtagactgaaacctccatcagatggaggctacaaatggaggagtatttcggaggaaaaggggttgaaagaagagaatggagagacatttagaagacacataggagaaggtaaactggtaaaatgtgaaagatgaaggggagagcatgcccaaggacagtggcatcatttacagagaaggacaaccttttgtcaggtggcatctcttggcccattgagagccagaataattgggtcttgatctcacattcctcacttttggaggtctgagtcttccccaacattttcaagatttcatgaagcttaagttctcatgatttcagtccacacactttcttccgtaatgctgtgggtttttgcacaatatttatccatatgtaaaacttcccttcacttgtccctgcaaaacacacacagacacatctctaaacatcatcgactccagtgaagagcttatggtcttccacgaaagaaagcttgaaaaattacttcctttacagtcctacactcaaacatccccttgcccacttccccctcccctgactgccccgactatttagactgtttagcttcatatcagtgcatggctcctctcttcactctatccttccattctcctttcttttctcatcctctttactccttttctggagccacaaatctctttcccaaacctctccctttcgcaggcatactggttcttccttcatttctgaacccttgacgctcactgacatctcagtccttgtgacgttggagcatggggtaagaggtgggagatgagtcatcttctactctaagtgtttatcaagagtattttcttccaaagataattgaggtcctggctataaagtgattctaatctatctactttattatgtggttaatatgaggcatggttgatgtggggtcatgtttgtaacagaaggtgacctgttttatcttagacaagtttcatttgacatgtctgtggcacattaaaattacccttatggttacagctaatctcctccctcctagaagatttttcttataaagtgtagaattttgtaggtggttctgttctttcttatggtcacacctcaacataagaaagttgactatggagtatcattattctttcccctcactggctcttcccatgctggttttgtatgatctgcaggatgatggtgtgcttagagtgttgatgtctccagtctgggttgaggaactcaactttctcctcagtcaacctaatcttgacagtctcttcagacctaacttattatcacctaccgatcaggctcatgacttaaaaacatgagcagtttatttacttttgtttaatcataaactctgactcagcatttttcagttagtacttttatttagaactatccttgcttgaaaagaagatgtcatcctttactctagaacattgacctttaaaaaataagtctagatagtgattatttttatacaggtatatcaggagccattattactcatgtgtttgttttgttttattaaataattcacacatcaagtaatgtgcaaaggatatgtaaggaacacacttacacttaatgctaatatttaacaaagtttaacatttttacgtatttgcttcagggttttttttttaaataaataacatattgtagataaagatttaagccccctttgaatccattcacaatccaattttcatccttgcttcaccaaaattgcaacatcctgaacctggcatcagttttacctgccccctagtgcgctccgtctgtctcgctcactctctctctctctctctctcgctttctttctttctctctctttctctgtttctgcttttgtattttttctttgatgtctttggttaacttttaatgcttgtgtatggctaatttacaatgtttatatagaaatttttattaaattcttctttaattaaaagcaaacaaacacaccccattccaagaaaatttctaaaattcaaaacaaaacgaaactctaatgtcgtttttttccagcttgatctatcagtttctgtgaaaggtatttttttttaaatacctctatcttttttttaaaaaaaaaaccttataaaagaaatttcattaaaaaaaccttataaaaatttgattaaaaaaccttacaaaagtagtttgataagcattattttcttatatttctacattttataacttccatcatttctttaacccataaattgatagattctgttttttgatgccagaaggtcatggtagaggtaactattgttggaacgctgttcttataacttttaaggtgatgcttgatttctaattcaattccattttgattaaacaacctggtctctacagtaattttttgaaatgtagtgagtcttatttttgacatagcatgagaacatttttaataaatattcaatatatggtataaaagtatgcatcttctctgtttggtatataattttttaagatcaaggttttttgatgtattatgtagatttttttatcttgctttttctttttttttcctatttgatctgtatctctgaaggatgtttataaaaatatcccaatattatatctccttggaactattttatcctgttccatgtttttgccctcaattctatttcacccccaatactagtattgctacaccaggtaaaaatatgcctattgagtcttttttttaaattttcaacctgatatagtttggctctgtgtccctatccagatcttatcacaaattgtaatccttataatcccggcatgttgagggacagacctggtgggaggtgattggatcatgggggcggtttcccccatgctggtctcatgatagtgaatgagttttcacaatatctgatgattttataaatctttgacagttcctccttcacacttgctctctctctcctgccaccttgtgaagaaagtacctgcttcccttttgccttgtaccatgactataagtttcctgaggcctcctcagccatgtggaactgtgagtcaattaaacctcttttgtttgtaaatcacccagtctcaggtattctttatagcagtgtgaaaattgattaatacacagtgtttttctgataatctgttttaagtatgcatccagcagagatgatatagcttttttaaaagatccaatatatagtagtgtcttttaatagattactttaattttatatttattgtgagcattcctgtatttggattaattttttccatctcattttgtgctatttaacatcattttttaacttccttttaatattcatttttgataccttccttggattatacactttttaacaatgtattttttttcccttttgccagtttggaagctactaattatattttattattttggtgattttgctttaattcaaaaataacaaaatacaatgtacatacatacaattgtacatgacagaaatgaatgatcacaaaattaacattcatgtaactgtcatacaagaaataaaacatttccagtatttcagcagtatagagcattaatgcattttaaaaatgcatcttttcccttccagttttaatgaagtataaatgacaaataaaaattgaatatacttacggtgtacgacatgatgttttgatatacatatacagtgtgaaatgactaccacaatctaaaataaatctttatattttgtttcttatgttatctaaagttgtgcaatatctctataccttcccaattgagatgaggacattagcaaagctgacttatctagccatcaaacactctttctcatcttctgtgatattgtttttaattttaataagacttatttgaagcaaagaaagtcagctattttatattcagtagttatataaattttgcatctcgcttcccttctctgtgccttttttgcttctttctaaagtacatcctttagtagttctttactactaatttacaagaattctaaacctcatgtctgaaaatgtctttatttcattttcattggaatgatactgtatccagttccaaaattctaatttaaaaattgtcttccctcagctctttgaaatgtttctctgttgctttcaattatttattgttactactcttaaatctactcacaatataattgccattgctttgaagagaatgtggcttttccgtttgataattttcaaaacatttctgtttattttcactgaaatgtgtcctcctgtttttattatgggacctcacccttccctcagctgtgttccatgcccctaggttagggacctggggccccatcatttgggaataaatctcccattttctgaactggagtgggaggggatattgcttagtcatataacctggagtatgggactcgggatctgattgttcctaatgcagactttcaaacaatccttctgtgtctggaaattttctgtaagtctcacattcagagctacctggtgcacccagttcctgacctttttctcatgtaaattgccttgcttccttttggcacataagtttgagggatctctgaactgctaaatcacataccgctacaccatctgctttcagtctctcaatatttagatatttcttgtctgttatcatcctcctttgctattttctttgtgtctgaagatttataaatatttctaaaattccttacagtaattttggagggggtttcttggaggtataatgaatgagtgcctatattcaatcttctacatttaaacaaaatttttttccattaagattttatagactttggaaattctattaacagaagatagggtccttcatttcataattagaaatatcccagggagacataacacattaacttataattataaatggctgtctgctttcctctttataattgacccccaattcagaattaattgcttccatatcttggttttatctccttcacatatttatggttttggttggcaggcttcaataactagacagtagacttcttgggattatgtcttagtaccatgacaggtactaaatactcatttgagtgcctggtacagaggttgcaccatacatgcttcttcaataaaatggagtgatttagaatcagaattaacacaaaaattttcctctatgacaagagtgtttctcacctattggcaagaaatttgaaccagatgttcactatgttaccatatttttctcccagatttgtcacatgatttgattgattactgggcttagaaaatgacattatgagtagatggaaaccctgtaataatggaatgacaatattacttggtatgtgtataatccttttattgtttaagatatttctatacccataattttttaaagtcttcatacatccctgcaattttggagaatagcaaggcctatttacaagatactggtgagaataatcatcatcaatttaggaaaaggaaaggaaattcccatatttgacattttatataaaactatgagcagtgaaggcaggaaactagaagggcttcttaaaggggttttaaaaagtatggatcacttgccaattgccaaagtacaggcctgaattttcctttccgtattactcttctcctaaggaatatgaccatgaggcagttagcacacacctgctttttgaagagaaatagaaaaggggatttggtgcaacatgtatctatctacagaaacggcctgtgtgctagaccacctgcccatgaagagtgacacagatatacttctttacccaattccacattctgaccagaaatggattacagctctgagctcatcctctctaatattttaaatggagggagtagagggacctctccttatgcagagaaacaaagttcttatttagtaaaaatattatagttagacacaattataaccacaaagatacttgacaaccaacagttatcagcaaagggaataatgataatttttgcctggcatagaaaaacacgctattgttaattctgagaattgtctaatctctcctcaagaagtgggaggcctggggattctggctaggctgggattctggagaaaagaataatatgggtttgagaagggttggggtctgtggctatgcaatttcgaacgaagtgtaatggaaccaggaaagctgggcttagacaaagaaatattttagaagttgaagaagagtttccaaagcaagaatcaaatctgtggaaaggattaccacaaagaggttgcctggtaggagctttaaagtctgctgattcagtctgaaaggaggattgtacattgacttgaggttatttatcgcagaatagcaaacaggtaatgcatcctctactaattagtattacagttcaattctggactggtcccatagaatgaggttttaagcatggattcagctagtaggaggtatacattttaaatgcattaaaggaaactaaagttttaaattgtaaataaatcattatgccatcttaaactgccaacaaggtaagtgaaagtagtgacctggttagcagtcagtagacacagtttcaagtgagcagcagaaacattctattgttatataaatgaagggagcagggaattgttgttcctccttcttcagtgagatcaaattaactaacatcacatcatagcatcagggaagtcacctgtgaatacctagcagctttacaggtgtgactctcttggttactgaaagagcttgtcagttgccaatctgagctatttttatgttgtgtgaaagctgaagaattcctgggtttgtggtcctgctgatttgccagacaaaatggacaactggagaaaatggtgctatttccttcttctaaagaatagacagatacctgttcatcacagaggtgggacttgagagctttatgaggctggcggttggagtcattcctggaaattccttttatgatgcacaggtttgtggagggagtctttatgtgtgtctcatggcttcttgataatcattaggttttagagaacttgctaataaattgtggttgacttctaaaaatgaaagttgcagattcacacaagaaactggaaagttaagaataggttatcccaagttctagtatggaaataggtagccatatgctgaaagagtaaaactttggtaattaaggggctaatgtatggactatttggaatatgaaatgtagttttcataatgtttgcaattacattttaaaaatcaggatataattcatataccattgctattcagttatttcaagtgggtaaagtggtttttaacatattcacaaattggtacaaccactagctcattccagtacaattttcatctccccaaaagaaagctgttaaccatccttccctgttttcctctcctctcagtccccagcaatcactaatgtgcttcccatgtctacggatttttctattctgggtgtttcatataaatggtatgatataatgtatggccttttatgtctgccttctttcactcagcacaaggttttcaaggtttcatctatggtgttgaatgcatcactattttgtttctttctatggctcaataatattccattgtatggggataccacatttgttattcatcatcagttgatggacatttggcttgtttcctctttctgactgataggagtaatgctgctataaacatccatgtgcaagattttatgtggacatatatttttagttctcttggatatatatccaggagtagaattgtcggatcatatggtgctgggtcatatggggactatatgtttgacactttaaggaactacaaacctacttcaaagtggctgaaccactttatatttcaccagcaatatatatgagtttcaattgatccacattccctccaacacttgtcattttctatattttagccatcggagtgggtatgaaatggtatctttttgtaattttgattttcatttacctaatgactaatgatgttgaacatcttgtaatgagcttattggtgatttgtatatcctatctggagaaatgtctattcaaatattttacctagcctttgattggattgtttgtattattgagtataagaaaatattttctcccattctgtggggtgtctttttcactttcttgatagtgtcctgtgatacccaatagtttttacttttgatgaaattcagtttatctgtgtttttaattgattttgcttttgatgttatatctaagaaaccataccctaacccagggtcaccaagatttattgtcatgtttcttctaggagttttataattttagctcttacatttagatctataattgttttggggttaattttcatgtgttacttgaggtgaaggtccaaatgtactgttttatgtatggatattctgttctcctagcaccatttgttgaaaaggctattttttcctcattaaattgtcttggcatccttgtagaaaatgatttgatcaataatatatgggtttatttctggactctcacttctgtttccattgatctatgtctatctttattacagtatcatactgctctgataattgtaactttgattttgaaattcggaagtgtgagtcctccagattcattctttttcaatactgctttgtgtattccttgttcttttcatttccatgtgaattttaagcttagcttgtcaaattttgaaaataaaaaaacccagatggacttatgatagagattgtgttgaaactgtagatcaatctgggaagtagtgccattttaatatcaagtcttcaagttcatgagtacaggatatcttacatttgttgaagtgctctttaatttctttcaataatgttttgtcttttgtggtgtaaaaaccttacacttctttggttaaatttattcctaagtattttattctttttaatgctattgtaagtaaacttggcttttaaattttatttttagattgttcattgctgatgtatgtaaataaattgatatttgtgcattaatcttaattctggaaacttgctgaactagtttattacctctaattttttgtagattaattaggattttctgtatacaagattgtatcatttgcaaataaagatagtattactttttcctttcctatctggatgcttttaatttcattttcttgcataatttctctggctaggatccacaatacaatgttgaatagatgtggtaaaagcagacaaccttggctcattccaaatcttggcaggaaaattttcagtcttttatcattaagtaaaataacagctgtgggtttatcaggttgaagaagttcccttcttagtttttttttttttaacatgtttttattatgaacatatgctggattttataaaacgttttttcagtagctcttgagatgattgtgtttgtcttttattctgttaacatggtgtattacattgatggatttacatacattgaacaaaccttccaatcctgagatgaatcccacttgtttgtgaactacatatataatcttttttataagttgttagatttgatttgctagtattttcttgagcattttgggcttatatttatcagggacactgttctgtagcttttttcccatgatatctttggttttgctacccggctaatattggactcacagaatgagttgaaaattgtttccttcttatgtatgttttggaaagttttgtgaaagattggttttaattcttccttaaacgcttggtagaattcaccactgaggccatgcagaattcaccagtgaagtcctatacttggtcttcagctttgatttgtgagagctttgttgattaataattcaatcttttatttattataggtctatttcaatttaatattttctatttcttcttcagtcaggtatggtaaattgtgtctttctaactttttgtccatttcatctaggttttcttatttgttggcatgaaattattcgtagtatttctttacagcctcagtaaggtcattagtaatgttccctctgtcatttctccttttaataatttacatcttttcttcctttttttccttgtcagtttgacaaaaaggtttatcagttttcaaagaaccaacttttagttccttgacttttctattgtttttctattctgtattttatgtatttctcttctaatctttattgtttcttttcttctgcttgcttcaggttttcctcttcttttctagttttttaatataaaaggctagattattgatttgtgattgttatgttttaaaataatctcttttaatacaggcatttacaaatatgtattttttctgcttttgttttatcctataaggtttggtatgctgtgttttcatttctattaatttcaaagtattttctaatttatattgtaatttcttctttgactcattcattatttaggagtgcattgtttaatttccatgtgcttataaatttcccaaacttccctctgctattggtatctaatttattttggttttggtcaaataatatatttgtatgatttaaatcatttaaatttattaaaacttgttttatggccaaccatgtgatctactctacagaatgtgtgcacttgggaaaaatgtgctttctgtttttgttggaccaagtgttctatagatgtctgttaatctacttgtttcatattgttatgcaaatcttatgttgcctttttgattctgtgtctagttgttctatccattactgaaagtggggaactgaaatctccaacaatttttggtgaattgtctatttacttcatttcttttagttattccttcatgtatgatggtgctttgttattagttgtgcacatatttacaatctagcttcttgatgaattaaccctttatcattatttaatgtccttctttgtttcttgtaactgtttgtgagttaaagtacattatgtctgatagtcctatagccactctgtctttcttttggttactgtttgcatggtgttttcttttccttcttttaacccattgtgtctttgaattcacagtatatctcttatagccagcttgtagttggaacactttaaaaaaatccattctaatctcaatctttagattgaattgtttaatccatttacatttaatataattactgattttaaaaaaggttttatgtatgtcattttgctatcagttttccatatttctatgtgttttttgttgttttttcattcctctcttatttcttttgagttaataaatattcaaggcactatttaaatttgttttcattagttttatagtattttttgaattcttttataactgccttggggatttataatattgatatataacaatctagtcagattaaaacaaacttaattgcaatagtgtacaaaatatgccattatatagcttcatttccttcccctttctttgtgctattatcatataaaatacgtcttcatatattgtagacacatcaacacagtttataattacaggttatgccattgttttttaaatcagggaagaaattttataattaaaaatacaatgccttttatatttacgtatgtattaactttatcagtgattttttaaatgtggattcttgttactgtctagtgtcttttcatttaagcctgaagccttccctttagtgtgtcttgtacagcagatttcatagcaataaattctcttattattttctttgttaggaaacaaattaatttctccgttaaaaaatagttttgctaagtatagaattcttgatgttcagtctttttgtgttagtactttgagtatatcatctcactgactctggtctccacagtttctgaaaaaaaaattagttattaatttcattgtaggtttcttgtatagcattagtcaattctgtcttgtagctttcaaaattctctttgtcttttgatattttggttattacatgtctaggtgtggaccctgagtttatctttcttggagtttgatgagatttttggatgtgtagattagattaatgtttttcactaagtttaggaagttttcagccattacttttttttaactatttgttcgttctgtctctttgtctctctattgcttccccttttattttggaactcctattagatgtatgttggtatgcttgatggtgtcccagtggtgtctgagactctgttaattttttagatcctttcttctctctattcttgaaagtggataaccccttccagtcactgaatactttttctgtctgcgcaaaacttctgttgaggatctgtagtgatttgtaaatttcaggtattgtacttttgaattccagaaattatatttgattattttgtaaaatttttgttttttaatgatagtttctatttgctgagacatcattctcatactttcttttagttcttcagacctgtttttctctctctttttagttccttaaacatatgcataatagcttatttaagtcttagacagtaagttcaatatctgggcttccacaaggatagtttctattagctgttatattttctgtgtatagcctatgcttttttgtttttttaatatctcataaattttttgctgaaaagtagaaattttaaatacataatgttgcaattctggaaatcagattcttccccaaacccaggatttattgttgtttgtttagtgacttcttgaagtaatccgtaaagtctatgttcttgtcatgtgcagccattaaagtctttgcttggctagcttagtggtcttctaatgattagacagagtttcttagtattctgtaactaataagtctcatagcgtttgctagggaacctactgttgatgtctgggcatgccttcaacactcagtcagacagtttacatctcttctttaatcttcacttcctgcttgttcagaacctcaaggtttgtcaggattgagagctcagggcctttttaggtctttcctgagcatgcacatagccctgagtgtacatacaaccctatgcatgcaggtttctagaaatattttagagctttcaaaatctccctgtggacattttcccctcaccttttagttttaagttcggtggtttgcccattggttgcccaacagttttctactatctgggagacccatgatgtttagcaattgcctctaatttttttcaacaaatgcccatgggaaaaagtctgtttccattcgggaagatttgagtcatgtcaaataaggaccagtgctgctgattccttttgcctgtgaacagagccaacactcatccaatagcttttcaacaaaacaaccttaattgaagagtcttgacagaatttgcaagacatcactaattggattccacttgccatctgctgcactatacctgacagagcccagtaaaatgtaaattcagaaccgatgacagagtgaaaggagaaaacaaccccttcctgataattgtggttacccaatctggagccttagagggaggggagaggtagcatcttgagtcttgtactaaggattgacattgaataaataaatgtgtacattttatttcctcaagatttatttgagattttctcacctttaatggagagcaacaaagaaggaaagcaggtatcatatcatgtaggataatttttcttaaggaatattattttgagaattattttcttttataaatatatataaaagtcatattgcctatgtttagcttgaagtgtatattttagtttaaaatacccagtgaactgaagatgacatttttctgatccatgagacctaactataaagatgttttgatttctcatattgcaaaaatgactccctaaataaaaagacgcagccaagctactaatgataaagccctctgattttctccttggatcttagtggaaataaattaaagtaaaataactttaaaatgttaatgccatgtatttgaaggagctagaccactgaaaagaatcaagcttacttatcagtaagaaagatgaagatctaatcatttcatggaagatccattaataccatatctgtactcaaactgcaactattctaaaaggaaaatatactcagaccataaaaatatgtttcccagaaactagagactggagaattcatccattcattctttatcgataaggtgatttctatgtgtcacgaattgttttttggggctgaggatacagtagttgaacaaaataggtaaggtccgtgttatcattaagcctacactctagtggggaagagagaacatgaactaaactagggtagatatgtaatacaatgatggatagtgttaattgtagtgaataaaataatgtaggttggaaaatagagggtaatgagcaggtgaaaggtgggaagaagatcctctatgatgagatgacatttgaacagaaacttgagagagtaaaccatggatatttggggaaagagactgccaggtagaatgaaagcagttaagaaacccttgacatagtccaggtaaaagaagatagtggcttagacagggtggtagtgttgaaagtggtgagttatacttggtttctgtatatactaaatattttgaagatttgctattaaacaggattaggggtatgtgataaagatgcctcaaagatgactataaggtatttgacctgagcaactggtgattaggggagccatttaatgaaaatagagagagggtagttgatgctccttccttctttgtttaggaagcctaaaagtgatttgccttttttttttttttttttgagatggaatctcactctgttgctaggccagagtgcagtggcacgagccaccatgcccagctaattttttttgtatttttagtagagaaggggtttcaccatgttggccaggatgatctcgatctcttgaccttgtgatctgcccaccttggcctcccaaagtgctgggattacaggcgtgaaccactgtgccccacctgtgatttgccttttaatttcctggaaccacttgtgtatgtgattcagctgaacaataccaacaggttgtggaagatctggatagaattgaaaccaacacaaaagcttttctgtaacaaaacagtacaaagtgtgttaagagagagaggggaaaaataatgacaaaaaagaagggattagaaaaagattgtgctttaggtaaagaaatttccagactttttccaggaaacctatttttcattggctaaagacctgggatcaaattcatgcttgaaatacatgactatgaacagttacataaaccttgtgaattgcagtttcttcaaatataaaacaggatttttttcgaggattaaatgataaatatagctttttctcctcttatttttattttattgttatgatttactgaaagtctcagaaaagccctatattgatgatccaattagtctctaagattatatattacaagtagtaactgagatccattaaatgtaggacatgatgatgagtattgaagcagattcaataaacatacaagatgcagtactatcctcaaatgatttatagtctaaatctgtagttaagcgaaaattcagaacagtattgatggtgatgcaaatgtgaatgctaaaaagaactgcttttaaaaaatgcaaacatttgttcatcactgagtacatacgaagcattttgctaagtgccttaagtgtgttatgacacttaagcctaagaaacaaacaatcaaaaatcctgtgagttaaatactggtatcacccttaggtcgaaataaaaagacaggcttgttcgtcatctgatactgagagtctaaaatttaacaaagttaaataacttggtcaagtttatacagcaagtgagagatccagacttgaatgcacacagccagaatccggtgacacgcacatacacttttcaccatttttgttttctcaaggaattttagaagttggagaaattgctacagattgtagtcaaaggaagtctcatgaaaggggcgaggcttgataagtttcctgaaagacaggtagaataagaaagagatggagaagaaaaagattgggtctgcagacatggctccatcagcaggtgaggggatttgagagttgggagagcacatagtggcctgggaacaataaggaaacatggtttgcttggaccactgggtttgtgttgggcagtaatagaagattgagttggactggtgagatgagactagtttgtagaaaatcttgaatgtcagccaaagtagtttacacatccttttttaggtaacaggagtcagtgaaagaatttgaatatacttttggaattatgtcaaattggaggagaaacattacgatagatagaagatgagaaaaacggtgaggaggcaattgctgtaatttatataggagataataaatcttagacaatttttcttcttatgaatttggtttcaaaaaataaaaccttataacctacctcccctctctttctcttcccttatttatgtcactgacactttgtcttttcttttgcatgcctttacctagaattagcattttcaaaggagaaagtcaccttggatagagatcatgtgttctaattttctgctttaaaaacaacaacagcaaaacaaacaaaacaacatctctgagccaaccaaaactacggagcttgcttaggattacactgtagcaagtgtcaaaacaaggctgaagctcatttttttttttttttcctgatttcttctgtggcactgagtgctatccattttctcctaccaggaaatcaaggaaaaggaactccagaattccaagatgactcttgacattcttttacctaggaaggtattggcagtcagcattgctttcagggaatgggataaatgtttcctagctatttaaagacccaatcagcagaaattatttttctgtacctgtgtcccgtgtcctaagagactaatcaggattttattatacatccagagttaaacacattgacatcctctaaagaaagcataagaatcaccttcttttctacatctgctagttagcaggaaagagaagagttgttactctctagagacacattttggcttgatcaactcatcaggggaattccttcatggcctgcaaagaaaacttacctgaatatgaagaaggctcttaggcatagaaaaagggaacaagtaaaaccccatgcattcttcccacctaggaaaataaatatggggtcttatgattcattacaggactctaatttctgagcttctttgagaaaactcagctctaaatttctttatcaacttttttgcagtagggatagaagactagaagttctattgcaagtttatacaaaacaatgtctatttttcttaatgttaatgatttggaacattacatgatatttttctattaaagatttctctccaacaaggaatatacagtgacttttaatccaaagcagactacagcagcctagaggaagccccagctgagatggagatgatcaggaacaatcaatatttcataattaaacctgttgaattcacagtaataaagctgcagttttaatttagagttgactgtccagagaaaaaatattctgacagcagtagaatggggagttgactttcatttattcctcagataaaggtgaattcattgtctatcaccttctgaccactgtgatgggttggtgctgagaaattgtcagaacgagagagacataatatcagcttggagctggcacttgataataatccccagaatgtaaattcctggaaggacttattcactgctgtaatcctcagaataagaatagtatccgacacatagtaggtgttctagttgaacaacaaatgtgtggtgaattagtgaataaagtgtttttatatgacatttttgtcttttgaatataattttgtacctgaaacaaacttgtcaaatgggaagaggaatattaattttacatagaagaaaaccacaaggatgtcagaagatttctaaggcttatggtcaggtgacagcactggcctcacatcccatccatttttaaaatattaagcagtgaaatcctttcttcaaacaaaattggactccagagttcaacaggcaaatcagatagaagctgagacacattggttcatataggtgtggggagcagacacctttcatttctgtaggcttcttccccatcccttttcatccattgcaaacactggataaatcatgctaattagatggttaggacatttgtgcttcttataagtaactgtcctctctgttacatagtttactctttattcagaggctactctagctgtgtgaccttaggcaggttacttaacatctgtaaatctcaactttctcatgtgcaaaatggaaattataattataaatgcctctagggttgttgtgaagatccatgaggagaatacatatagcagttaataaaaggcatggtacaaaataagtgctcaatgaatgtgaactataatggtggtgatgatgatgatgattgagataatggtgattgggaggaagaacagcttttgatactcacctggtctaaaacaaaacaaaaggatgaagtagggctcatttatttttcccgtgtgataggagctttcaatattaaatgaaatatataattatccatttcattttacattacagacatgacaaccaagatataaataaatgtagagaataatgtgttcttgcttttgtggtgtcagaaagcatttattttgctttttaggtttaacaaaaaggttttgagcacagtttaggacattaaaatatacaattaaatgccattttaattcatgtgaatatacgtttatgaaataatatctgtgttccagctactctttcaggctctggggacacagaggtacacaaaacactatcttgtctttaaagtgctgaatgtctggtggaaaaaaccattatagtaaggtaaaatcaagtctgtcgctgaggtgtcctcaaattacttttgcaaaaattgaaaatgtccatatctttctgctcattttgtttatctgggttttttctaatatatttctaaggacaaggcttatggggaatgatatttcctaggttcttgaatattgataagaatttgtctatacctctatatttgaaaaatcagtttttctggacatcaaatcattgtctcgcattttctttatttaaatatttttatttaatactttgaatatccttgttcaattttcttttgaaacattgtcctcaaaaaggtgtaatctaattttttccttggtaagtcatatcctgttattacctagatttccaatgagtttctttttctttaaaatccattaatatcactagattatctcttggtattggttgaagtcttagtatttcttttgatccttggctttttctttttcagaaactactattattcatatgttagatgttctttgcctgtcttcaatatttgtcactttgccttgaatccttgttatctttttctacccttctacagaattaaaacaaagtttttaattttacatttttctctaaaggcattatttgtcttatttattcatgtttgtgttctttctacactaggttttatttacaaaatgatattttctttttttaaccatttattatcacctaatttttgagtttttccagttattattttttttaaattatagattttttccttttttcaagttataacttttaaaactcttttaagtattcattttgaaataatttgtatctgtcaaagttacagtaatagtataaaaatattcctgcatatctttcacccagcttacctaaatgctaacattttacatatctgtaagataatgatcaaaaccaggaaactaacattaatatactagtattaattacatacattattcagatttcaccaatcattccaataatgttgtttttccaggatcatatattgcatttagtagttgtgtcttctcaatctcctctaatctaaaatagttcctcaggttttttttctgtttatcttgacttttttgaagagtactggtgagttatatatagaatatcccttgaattgggtttgtctgatgtttcctcattattaaatagtggctttgtatttctggcaaggttgtcacacaggtgatgttgtacccttctcagttgtatcatatcaggggcatgtgatgttgacatgcctcacaaatggtgatgttaactttgatcatttgaataaagtggtatcttccagacttctccatcataaagttactattatttgctttgggattagtaagtgtcttgtggggagatactctgatgtgaatcttctgttgctcattatagttttacccactaactttagctacattgctgattgttgcttgtatcgattattactgtgatgtttgtcaaatgataagttttttaagttttctctaaatgtataaatctacttctctatgtactaattggaattctactaaaattaagagctattccttcttccctacttatttatttaaatcactatgaatttatgaatatttaatttattctatgggttataacatagtactattgttcgtggtcaaatcttactgcatttcaccattgtggttcccttagaattgatctctgcgtcatttcaacatgtctccattatttaaaaatacttccttattttttggcaccattatatattctgttccagactgatattcttttcttctgccccacctctgaaaccaggcatttcttcaagcagccctggtttcttttattcaataatggtatttagaaactgatatctgggaactagatatgtttcttgcttgttagtatttctcggttcttctagcagacagagctgggaaatagatgtatgaatacacacacaaacacacacacacacacacacacacacatacacatctatttctttatctatctgtaaatttaaaatcatgagtttatgctgatacctctgatttcaatacaaaatcacagagttaattccttatttgtaattcctttctgtaacagtgagaaacctggttgttgttattcataattgatttacttatttattcaatcctagaatacacataaagtagttttagaattgccagctcagaattgtgcactgctatgaaaaacaaatttgtgtattgttctttttatccttagctttaccatttatagccaaaattttattttctaaagttactcagttcagttcttttcttcttacttcgtttagtgttagtcacttgtgacagagtttatttataaatgtttgtaacccatttgggttttctccatggctcttgtgtttgattatatttatttatttattgatatgaatatgtgaaatgttaacttggttctaaaagttgaaattagacaaaaatatatgctcagggaaatgtcacttgcccctcagtcttcttaccccattcccagttacccattctctgtttgttataccccatgtccaccccatgtccattaggccatcagtcttattagtttctgatttatctttcttgtattttcttgcacaaaggaataaatgcatgtttattgttcatctccttcattcttagctatgctattttatcccttaactgtatatttttatttgtaaaagttatatttcattcaactttatcatttaactccacatcctaaaaattaccactccatatcaactcattgggattttcctctttttttacatagttgcataatacttcattttgtgacggcaccaaattattcaactactctcctttatggaaatttacctttgtatgctaatattgtatcctgctactttactgaattcctttactgtttgagttaatagttggttttctaggtatgctgcaatgttatctgcaaatacacatggtttcagatcttctttactgatttgcatgcttctgaataatacctcttgtctaggttcattgggtaatacttctaattatacattgaagagttgtggagagagtgatcctcattaccttgtgcctgctcttagtggaaattcctctggagtttctccattaaataaaattcttcctttaagacttttagaattcctggctttaggaatgtgtgcatgtgtgcctgtatgtgtgtatatacacacatacacgcacagtatctatcaattcttattttcttgattgtctttatcaggagtgggtgtggaatttttcaaaggtttctatttgctttaattattataaaaataataattagttcttgatttttaaacattgtcttttattatttcctattctaacaattttttgtgagaattaaaaagaatttaaaatttcagattttaaataaatgacccttagttttatctactaaataatgttatgttgttcaaaatgtcagctggttgcaatggatgacttcaagtggttgttggctggctggcctcagaattagtagcacagcctaaggtttcactgttcacttgcatgtgtatttggcaaattcttcacaaacagttgttggtcttgtgaacacaaaagtatctgagacagatctcaatcaatttaaaaagtttgttttggcagtgttaaggacgtgcccgtgacacagcctcagcagtcctgatgacatgtgcccgaggtggttggggcatagcttggttttatacattttagggagacatgagatagcaattaatatgtgtaagatgtacattgattgggttcagaaaggtgggacaactcaaagcgggggagggagcttccaggtcataggtagataagagacaaacagttgcattcttttgagactctgattagccttttactgaatacacaagttccatgtgagaggaaactagaggagtagtcacttatgcctgagtctggcttagtgaaacaacagggcagagaaagccattatatatgcatttgtctcaggtgaacggagggttggctttgagttccgtcatctttgtccacaaggaatctccttgttggcaaattgtgaggcaggtatgtagcttttctatctttgtagctatcttatttggtaataaaatgggaggaaggttgtgcagttcccagcttgacttttccctttagcttagtgatcttgaggtctcgagatatattttcctttcagtctggtgacgtaactttagaaacttccaacgcagagggctgactgtttcacagggagtaatatttaatttattcagtcagttgtatgtgggaacaagtgttgtgtagaaatgtgaattaactggctgggtgcggtggctgacgcctgtcatcccagcactttggaaggccaaggtgggcagatcacctgaggtcaggagtttgagaccagcctggtcaacatggcgaaaccctgtctctactaaaaatacaaaaaattagctgggcgtggcggcacatgcctgtaatcccagctactctggaggctgaggcaggagaatcgcttgaacccaggaggcggaggttgcagtgagccgggatggtgctctagcctggttgacaagagtgaaactccatctcaaaaaaaaaaaaaaaaaaaaagtgatttaactgatcacgtgttcttgattgatgcaagtgatgcggtagggctctctctatatttgcagctaatctggctcatcacttaatctggtctgagctgatttcagctgaagttgtcctggtcgtgtgatcttttgaattgccccattgaatagctgaatgatattatgaaatcagactagtgaaaataacttagaaatgaaaaccacattttaatcttctctattggtgttcaaattaaaacatgtaagagactaacacaacagtgggaaaaatgggttgggcaagtatgtaagtgggagtgtctccaagcttttggagctggctctgctccagatgagatgctaaaagtcctaaatatgtgttctagttctggaagcatggtggcaataaatccctttataaagtaataattcctttgtgaatgttaattttcttcttaccttaaattctagtagaaagcactgcttctttcactttaatgtgcatacacagtccattaggatcttgttaaaatgcagactcagggttgggactagagtttctacatatctcacaggctaccaggtaatgttgttgctcctcctttgtgactacccttggaggaacaagggcataaagaactattttgtatttagacctaccaaagttcaaatgttaactatgggtaatttctttcacaaagatgacatttgaacccaggtcagttcttctggcttatctttaaagattttggctttcccatttctgggctctggggtgatcatgcctctggtaacccatttctgggttcctggaggtgtgtaggaacacctgtgttagatctcttatcttcccttgctctctggattattgactctcctgagcattttgcgtgacaaaaaatatcctgaacataataacatgtccctgacaaccctggttgttttgagctttagaacaactgtagctttgaaatgaagttgtcttttggttttttcctcttttttcttttctccatccaaaccatgtttatttggaaagctctgggtgcagtgtctggccgatagtcccccatgctcttcgtcgtgttcttgaagctttcatgcatctctttgccttcatagatattctcctcctgcacccttcctgccttcttcacctaggatgtacagtgaatggcgaagctgctgcctaaatctcaaacatgctgcctctctttaggctccagagcttgctgtgctgcaggcactaatattatctagcctggcatcattcattcagtctgatgggctctatccctctgtttttcagtcatggacggatgggagatttttgaatcctcttgtattgggacggcagccctatagattcatttttagaaggtgactcacttttcctctgtctctgcttgtggtcctttcttggctttaggagttctggtagttcaggatctagttgttaaagcccgcggttatgttacttgtttcccaacctctggaggatccctgttctcagtagataaacgagatccacaattaatgttaaaagaattatttttcgtggcatcattgtcctttagactgtccagcctttaaggttcccttttaatcagaatgtcatgcagctggtggcttctattcagtgaccctttagttaggactagtgctgctgattgactcttcgataatttcagttgagatgcttttgtttggtcataaaatgaccatattttctggagatcagaagctgtcttctcttttcttaaggaaaaagatatgccccacaaaaacctcagttttaaggatttccagacattggctgcaaatgcctgaaaagaacagaaagataatgcgtgtgggaaacaatcaaggtaaacataggcaataaggatgcctgaccctcagtggcatatgaaattcccacctaaaaacattcagtcagtgcaaaataattcagtctagttctggtgaagtattccaactctgtaccaccttctaaaattaaggatctaggcaaggttatcacatctctggtgtgcatttgttgagagagttacagggatgcaagcatttcaaagctaaaaatgcagcattcctagacaaactggatatctgagcatcctagatctggcatatttagtgcctataaactttatcttaaactagctatttaaactaaagctttttaaaataaggaggacaagtcagatcaaatgtctttatttgtgaaaaacaaaatgaagtggataatttttccctgtaacttattttcagtgaagggaaaaataacatcatcctttgatatttgcagattattggttccaggacaccttccccacacccacctccatggatatcaaaattcgtggatgctcaagcctcttatataaaatggcttagtacagttggccctccatattcatggatacagagggccaactatagcaataatcaccattttatgattcttataaagaaagcagaacttcaaactatttgagagaggaccacttttcagaaattataggcactgaatttattgccagccagtcatagctgtccatctgctaattctccccccatagaaggagcagctgtcatttcagaaatgctacagtagataataagatagggtgcatttcatcttcaaatgcttaaatccctgggaagagcagcaacagctcttctgactgcatgaatctctgatattattaacacaaaatgccaaatggattcagagatcagaagcaaatggattcactttaaaaggaaaagcactcaagttaggtgttgtacatattataataacctgcatttgcatagatacagggactgccaaagccctagtcacacacagagatactctccaaatcataaccaccatagagtcctgaagacaaatacaatcacatgggcttcccaaatccacacaacctatctacacaaatggaatgattcattgcctctacctccaaaacagacaacaaacaaaccaaattttccccaaaataagagctttcttaagttctgtatgtctcacattggcccaatttctctccaaatctctatgtttaaatattcttagatgtggtcctcctttgtgtgctgtttaacagcccaaatttcaatcagcaatttctactgattatttctttgcattttttcttagatgaattcttttctgttcagcctactgcctctacccttaggtgtgtccaagtacactgttacttaaaaatgaccacagcctcttgcctggagttcttagtcaagacacttctcccttccattcaccctgcatatagctatctgattattctttataagaaaaaaaaattaggatgaggtaaggaaccaatgaatgtagtcaaagttgtgctatgcatccttgagcattttagatgtagatgaagatgtagacatagatacagatgtggatatagtcatgcacacagacataggtagagatagaagtatatgatatttctctatagggatatctaaaatagctatttcattcgatcctcaaaataaacctagggggagatttgacttatttatttcacacatgagaatgttgactctcaaagaggtctcaaatcctatatctggtagcagcttggagttggaactaggtcttattcaaatttgggcttctggtttcagcacaaaactttattttttttattcttggaaattgtgatctaaaatagtatttctgcaaagtggtaatacgtgagccttctccatgtagatgttgcccctgaacttggtttccatggagcatagggaaagaagatgtagagagagttcatacagaattgctggctgctggacacatgtatgcttgcattttcatttatacaagcagaaatgcttttaaagggcctcaactaatttcgtcacagtcagtgttacaaaggaaaaaacaaatccccagtgttgatgagaatccaggtcaaggcaaggagaaatcacagagcagtcaaagagaatcctggggctctgggatgttgtgcctgcaagtaccttgatttgagaaaagcaattcatttaaacacagcaaatgtgcttgggagcaagtctgggctgcctgttcctttctgttgctatcggcattgaaaatctgcttcatattttaccttcatccttggtcaccaggcagaactgataaactctatttctagatgtcattgctattaaaaacagaaagggagaaaaaaagcaggcaaagaataaaaaatgccagagaggaacatgcacaagacctaccatttatcaagtcaaaatattttaatggagaaatcaggataagtgattaatctgaagatttttagtttccagtaagttgtaagaaggtctgacaggcaacaggaagctaatatttaaagataatttcaggaacatggaaatgaataagtggtaaaaggagaagactgaagactgaaccttctttttacctccaatgtttattgaaaacactgtgtttcaaacaaaacaaaacagaaatcatatctgattctgcatatgaatgctggtaaatttattctttccaaattatttatccaatatcaactcttgacagagttactatattagagttttgatggtgaccaagagactatcactgtccctgcccccaggaggctcctagtctaattgggaagtcaagagaaataaaaataaaaatccatccaaaatggttttataaggactctgatcaagggggcctcaggatgttattgcagcaaataggagatagatgcaatggcctggaaaatcagggaaagttcccctgcagattgatcccctaaacgttgaagaggtaggggtacatgaagatggaggagccccagccaagacctatgtatgataagatagaatgggtgatgtattgtgtactggtttcttagggctgttgcagcacactacaacaaactgggtggcttaaaacaacagaaactcatttcacacttctggaggccataagtcaagtgggaactgttagcaattccactgagcttgggtgtggaaggacaatggtggaggatttgggaggagttgggggtgctggaggtgttggggatgctgtgctgatcctcccaatctgtggcacttagctcattgaccctactgagtaaataataccttagcaggactactgggaatgtgtcctgtgcaggggctgcccttggtaatctctggtggttgtgggtttttaggatcactctgcctgacaactcagcatctcagtttcctcactgtgagtggcagtcaatcctttcactaccagctaggtcacttttgtaaagtaacttggtacttttgaatacgaacatcatcattcccccaaataagggaatgtatgattttgagctcattattgctctaatataccatgatgatatagttgaaaaaggcactctgattctcttggtaaatgtcaagcagtgcaatagaagagagagaacagggttagaagcaaataaatctggggggaaagcctagctccttcttatggcctagatctccagccatttaataatttataagcctcactctcttcattggggtgttctaatgtctaccttgcagagttattgaaccagctggaaatatcatatgtaacacaccaagtatgatagattgaatgcaacttaattatctgtagaactgaagaacgcatagcctagagaaatttattaaatgtattccccatggatgtatataatggggaactacattttccaactttgtcttaaaactctgataatctgatagcaagtcaaatatggtttctagttcatttgggggttgtgaataattatgatactttggagcttaaaggacagatctacagctttctagacatctgaaattgatgccaattgggaagaaatcagaggaaagttttgaagtcattagtttaattgtttatcttgtggagctttattttctcaagttattttcttctgaatgtgtatttatttgcttattatttgttcctgtagccacagatgctcactgagcggggaagatttgaacagacaatggctttctcccagtgctcatctgcagccaaccatttaccatgccaaaggcctcctctaccacctgagcagcattggccgaagtcccgtggtgagtcacttccttctgcctccaccttcctggctgcttccttctaccttccaggaagcagagtatattctgccaaggcaagaatagacaatgaccaaaaacctatgtatgacaagatagaatggaggatgcatggtgcattgacttcctgggctgctgtaccaaactgccacaactgggtagctttgtgtaatgccagagaaacttatctcacatttctggaggtgtgagtctggaatcagggtgttggcaggatcatgcccactctgatggctctaaggaataatccttctttgtctgttccagcttctggtggttgctagcaatctttagcattcctgggcttgtggcagtgtaactctaatctttgcctctgtcttcacaaggccatcttccctctgtgtccaagttgccctcttctaataaggacattagtcattgtattagggcttattctaattaagtatggcctcatcatagttttatcatacctgcaaagaccctgtttccaagtaaggttacattcacaagtaccagggattagaacttgaatacatcttttggggggacacaattgaccccacaacaaaggcaaacccccagcgtagtagtcattggtaaaaactgggcaaaaaatcatatttcattccatatcctgagtcttcatttttctggtatctcagttattgcataagaaagaaaatgtatatacctattaaatagtgtttggaacgaaatcctctaggtgtttatgttcaactaatacttatattccaaattttattctggcactgccccagggatttttatatctaggctgttttcccaagcctctagtactatacaattgattgaaaaaacactatttgaaaccagaggacttggctcaagataataaagagaaaatggcagccaagtaaccatatgaaaatgctcatttattaactacaaactgtgaacatacctgtctacaaacatgtagagggacatacgtccaaattcagagtccttacctaacctaacaaacttaaaatagagtgaagaagctcacatacgggccaaatcaattaatcatctctacctttagccactttttgaacatctactatgtgacaaaaaggtggcacattcaatgaatatttatttttaaaatggatgaatatataatgtagaatcttatttaaatctcaaaagagatgaacaagtaaactgatttcaatgagatcacccagaggtgtatggcagagtgggaattcagttctgatatgtttttctaccctgcaacatagcctctcttcattacttactgttgaaagcgtgtgttggggagctccatgactatccgcaggctcagtgattccttagaaggactcacaggactcagaatagcagttatattcataattacagtgtattaccttcagaggacacagattaaaatcagaaaaggtaaatggcattcatggcagagtacaggagagacaaggtacaaatttccaggtatccttgcccagtagagatacacagacagtgcttgactctccagcaacaatatgggttgccaaccaggaaacctcacttagctctggtgtccagggtttttgttggggggtcagttatgtagccatcaaatatcctacgtggctgatcttagttactctgtctcccatctctccagaggtcaaattgatatctcatggtcctagagccccaccataagtcacattgttagcatcaaccatctggcatggcccaagtcccaaggtaaagaaagatctgttatccagcagaatattccaagagtgtgaagtttatttcctaggagtcattcaagggacagatcttatttcagagtgtgcaggatttgaaccctctagtcttgctgagtcaatctttttttgcttagagaacaaagtggattcttttctcttaagaatcctcattctgaaagtcctagccagagcaatcaggcaagagaaagaaataaagggcatccaaattggaaaagaggaaatcaaattatttctgtttgctaatgatatgatcatatacctaggaaaccctacagactccctcaatagactcttacatttgataactgaattcagtaaagtctcaggctacaaaatcaatgtacactaatcaatagcactgctgtataccaataacaaccagctgagaataaaatcaagaactccgttttattaacaatagctacaaaaaaaaaatacccaggaatatatttaacaaggaaggtaaaagatcactacaacaagaaccacaaaacactgataaaagaaatcagacatgacaccgacaaatggaaaaatatcccatgctcatggataggaagaatcaatattttgaaaatcaccatatttcccaaagtgatctacagatttaatgcaattcctatcaaaatactaacatcatttttcacagaattagaaaaaacaatcctaaaatttatatggaaccaaaaaatagctgaaaccttagcaaaaagaataatctgaaggcatcacattactggatttcaagttatactaccagtctatatttaccaaatcagcatggcactggtataaaagtaggcacatagaccaatggaacagaatagagaacccagagataaagccagccacctacaattaactaatctttgaccaagtagaaaaaatatatattcagtaaatgacgctgggaaaattggatagccacatgtagaagaatgaacctggatccctgtctctcaccaaatacaaaaattaactcaagatgaattaaagacttaaatctaagatctgagtctgtaaaaattttcaaagaaaacctacgaaaaactcttctggatataggcataggcaaataatttatggtgaagactccaatttatggtgaagacaacagaaacaaaaataaataaatgggacctaattaaactaagtaccttttgcatggcaaaagaaataacagagtaaacagacaacctacagaatgggagaaaatgtttgcaaactatacatctgataaaagactaatatccaaaatctacaagaaactcaaacaaatcagcaagacaaaaaagaaataatgttattaaaatgtggttaaatgacgtgaacagatatttctcaaaagaagttatatgagtgaccaagaaacatgagaaaatgctcaacgtcactaattatcagggatatgtaaattaaaactgcagtgagataccactttacgccagtaagaatggccgtttttaaaagatcaaaaacaacagatgtaggcatggatgcagtcaaaagggaatgcttatacactaccaatgggaatgtatgttagtacaacctctatgaaaaacagtatggtgatttctcaaagaactaaaaggagatctactatttgatccagcaatcccactactgggtatctacccaaaggaataaaaaagttattgtattaaaaatatacctgcacatatatgtttattgcagcataattcataattgcccaaagatatggaatcaacctaagtccccatcaattgatgagtggatgaagaaaatgtggcatatataaatatgcacacagatatgtttgtgtctgtgtatatatatatatatatatatatatatatacacacagagtatatatatgtatatagtgtatatatatataaatacacagtatatatatatatttatacacagatgcacatatacatataccatggaatactactcaaccttaaaaagaatgaattaatattttttgcagcaacttgaatggaactggaggccattatcctatgtgaagtaacccaggaatgaaatatcacatgttctcattaagtgggataagctacgggtatgcaaaggcatacagactggtataatggacacttggagaaacagaagggggttggtgggagtggagtgaaatgaaaaattacctgttgggtacaatgtacactattcaggtgataggtacacttaaaggggactttaccactatagaattcatccacataaccaaaaactactaaagctattgaaattacaaagttaaaacaagaatactggttctacactgctgaaaatgtacaatcttttcattctgaccttctccctcctgcaatcttagaaggcactgtaatctctgcagtctaccctctggaagcaagcacatggcctgcacagcaggtcacaatttgaaaaaagtatgtttctctgagtagaaagctttagcttctaagaggagagacagagagtgggacttaaaaggaagaaatccctatataatacacatttaaacacgcacacattcaatccacaacaaaacagaattcctctctgctctgacaacctctaattgaagagcagaacatttattttaaagcatgacaggtgaaagccttgtttaaaaatataaataaacattaattagctataaacatgacagccacagacatgtttcctgctgggaccatctgagaggtgggtgagaaacagctgagcactaaatgctgttcacagtgttacaaagctctctaatgggctcaacatcaccttttagttacctaggaggctatatttaatgagtctcctgctggcagcagaagcgctgccactcactcagcactcaggcctatcctgtactgggaagatttccactgcgacgagattaactgtgactctgcccaaattctggctcttatgaaaatgttttctgaagcactgggaagccactttatggtggctaggaagatccaccggttctagatactattcagccatttgcttattggtgagtggattaatatgactcccaggaccaaaaagaatgtggtactgtgagaaaaagcagtaccctgagagcgttgagcattgctaaataccagacaagtcattcactttatagtgaatatggcaatattcacatattgtgtaattcctccactcatccatatatctgtccatccactcacctagccatccatcatccattcatccatccaaccacttatccatccacccacccatccacccaatgtaggcagtcattcatttcttcattcacttgcatcatatatgtataattatggtgctacgtgtcagggatacaaagaaaatattttatttaagattgtccttttctggggggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgggtgcacgcaccgggcgcgaaccgaagcagggcgaggcattgcctcacctgggaagcgcaaggggtcagggagttccctctccgagtcaaagaaaggggtgacggacgcacctggaaaatcaggtcactcccacccgaatattgcgcttttcagacctgcttaaaaaacggcgcaccacgagactatatcccacacctggctcggagggtcctacacccacggaatctcgctgattgctagcacagcagtctgagatcaaactgcaaggtggcagcgaggctgggggaggggcgccggccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagccgatggagctgaaaaccaaggctcgagaactacgtgaagaatgcagaagcctcaggagccgatgcgatcaactggaagaaagggtatcaacgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaaattggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagagcagccagagagaaaggtcaggttaccctcaaagggaagcccatcagactaacagcggatctctcggcagaaaccctgcaagccagaagagactgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatatcaactttaaatgtaaatggactaaattctccaattaaaagacacagactggcaagttggataaagagtcaagacccatcagtgtggtgtattcaggaaacccatctcacgtgcagagacacacataggctgaaaataaaaggatggaggaagatctaccaagccaatggaaaacaaaaaaaggcaggggttgcaatcctagtctctgataaaacagactttaaaccaacaaagatcaaaggagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataataggagactttaacaccccactgtcaacattagacagatcaatgagacagaaagtcaacaaggatacccaggaattgaactcagctctgcaccaagcggacttaatagacatctacagaactctccaccccaaatcaacagaatatacattcttctcagcaccacaccacacctattccaaaattgaccacatagttggaagtaaagttctcctcagcaaatgtaaaagaagacaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactcaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagtcaaagacaaaaaccacatgattatctcaatagatgcagaaaaagcctttgacaaaattcaacaacccttcatgctaaaaactctcaataaattatgtattgatgggacgtatttcaaaataataagagctatctatgacaaacccacagccaatatcatactgaatgggaaaaactggaagcattccctttgaaaactggcacaagacagggatgccctctctcaccgctcctattcaacatagtgttggaagttctggccagggcaatcaggcaggagaaggaaataaggggtattcaattaggaaaagaggaagtcaaattgtccctgtttgcagacaacatgattgtttatctagaaaaccccatcatctcagcccaaaatctccttaagctgataagcaacttcagcaaagtctcaggatacaaaatcaatgtgcaaaaatcacaagcattgtcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaacgccatccccatcaagctaccaatgactttcttcacagaattggaaaaaactactttaaagttcatatggaaccaaaaaagagcccgcatcgccaagtcaatcctaagccaaaagaacaaagctggaggcatcagactacctgacttcaaactatactacaagtctacagtaaccaaaagagcatggtactggtaccaaaacagagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggtgtgggcaaggacttcatgtccaaaacaccaaaagcaatggcaacaaaagccaaaattgacaaatgggatctaattaaactacagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaacccagtcaaaaagtgggcgaaggacatgagcagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattggacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagataacgagttagtgggtgcagcgcaccagcatggcacatgtatacatatgtaactaacctgcacaatgtgcacatgtaccctaaaacttaaagtataataaaaaaaaaaaaaaaaaaaaaagattgtccttttctttgaggaacccagattttactttggtagaaagtagagtcaggtctacaaggaaactggagtggtagaaaatagtaagcactgtaacaaaggcccatgtgagctttgataggaacatagatgaagggttgagtcattttctctcagggttatggaaaagccagagattagaagtaccatttgagctggacttgcatgaagaagagtttcccttggattttattctagtaaggctgagaaatattctttcctcaaagaatctgtaggcctatgatctcttgagtcttctgccctgtgaaattgaaagtccaggagttttctgtgcttggggttactacacagggcaaaggaaaagaagcttctcatttgatgggtcgcagagattcatttgatatcacacagaccttcttgtgactccattcccattttctttaacccaggttttctgtctcttttgtttgttagagagtccagatgttagatacagaagcccagacacagcaaagtttggtatatttatgcactggaatattattcagtaactaaaaccaaaactaaaccaaaaaatgaactatgatatagtcaataacgtgggtgaatctcataaacattatattgagtgaaagaagctagacactaaagactacatactctattctctatgtgtctgtttatgtaaagtataagatcagtgaaagtaatttatggggacataaattgaacagtgtttgcctctgaggaagagcattgaatagtaggggtcaggagggaactttataggttagcagagatgttcaatatcatgatcagagtcggttacacaaaaactcattgaactatatattcaggatctgcgtttttcactctaggtacacatttacctaaatgcagaaaattaaaattaaagcaaagtcacagagatttaaaatgcaatgaggagacaaagggggctcccttaaatgaagctgactagcatacaggcatgtgagccaaggaaaacagttttcccaggaaagagcagaaaggttgtagaagaaggtctgtttagaagtcagaaagatccagccagagaggcggcctataagcagagaagcccaaagaagcggacaagctctacaatcagctagcagaaggcattgaaccagtttccctttgtggagctccctctaaaagccaagaggctcatggccaaggaggcagatgaggacagtcggggacatccctgggactggaagaaagttcttaggctactacagcaagctcctggggagccaggtggacagcctcttctgagctgccatattgcagctggcctggcccctgtgctgttcaagtaattggggcttcagaaatgggaatgggatcgattcctatcctcttggctctcactatgtgagtgcattttggtaaagggatttcagtcctctttgaagagcgcatcaatttctgtttataactcacacaaactgagctgccttctgccagaggacagggtgggcatattgtagttttgtctttctctggggcccagtggaatagaatttttagctacttaaatgatttttctggttttattttgtccctctggcatatgttttgggttaatcagcttcttttaaaagaagcacaaaaggagatgaaaaaaaggatggcgtattcctttctataacccttgtcgccaagggcctcaagatattttatacacatgaattgttttatttccactttattccttagcagtagcagaagaataagtgttatttttgcttattttcataactcgtgttaaggtaccacatctagaatttccctttttttacatttgaggatatggtaggaaaagaacaaacactcctgttccatagtcaggaaggacagaatacccataaaggtcctgaattaaaaatatttcagtttgcttccatattcttttatttggaattgttcccatgctatcagaatgaaggttaaacaaggcttctttaccataccagaaaccaagttttgtgtatatttttactgacacaaaaaaactacatttaattgaattgcttcagtttcttgataaattttagtgaaaagcaaagggcattttttctcttgctctcaacagtgtcttcaatgtagtttctgtgtaacacaagagctgaaaatctgggatattcttttttgtttgtttttttgagatggggtctcgatctgtcaccaggctggagtgcagcggtgcaatctcagttcactgcaatttctgcctcccgggttcaagcaattctcctgcctcagcttcctgagtagctgggactgcaggcacgtgccaccacacctggctaatttttgtatttttagtagaaacggggtttcaccatgttggctaggatggtctctatctcttgacctcatgatctgcccgcctcggcctcccaaagtgttgggattacaggcatgagccactgtgcctggtcaaaaatctgggatgttcttagagggagggcaagtcagaattttcaaagaagtctaaacaaatttcttatgttttatttgttgtggaatggaatgaaatgaggagatggaggggaggggaaaataggagggtaaccgcttagaaagcattcctcttcagcctttgtgaaggtccctctgcccagagctagtggaaataggtgaaagcaagaaatacatagagatggggccacagggactaattttgccataaggctgctctccgtgaaggccagaagtgaaaacagaggcttccgatgaagacacggaagagacttgtgcatgtctgaagaaaactaatctggtaaacacagcaaggtagcaatgatcgtggccaagggcattgggcgtagggcttaaagttctcatcgcagacagtgagggttgcccagagcaaagcacagtccatccttgggggccaaggcaatcaacagttctcagttaggaaagcaactcagaaacagaggcaaaagccaagggcaaatctctttacagggactgagtaggcatggtgataggtcagtattcagtccccagcctaccccaagggtttagccagacaatatagaagccttgttataggtcaaaaagactagtctgaatcccacattatggtgaagacagaggtcccaataaccatctgctctgattgggcttggtacaccaaatagattaatgcttctacctcgagaacttcagtacctgcaactgagcgagacagatggcaaaggcctctcaggctgataggttgcagggattgtgtagaaaggtgacatccaggctactgcttctctcccttcaatgtctgaaactggggaaagggaacagatttaactcttgaggaatcttcccaggaactcactgcataagtgccttctcagggcattaggcttaccactcatggagggatggctggccagagatggagagtggaaaaacgcaagaccactcactttcaaatacgcgaattgagagttttgttatattgttcttcatcactcgtccatcaaatgttttaaaatgtcgtgtttggaaaacttttagaaccacactgattagagtttgagatatcacacatcactttctaatgggtccatctgcaagttgcttaacctcctttaactttagaagaaattgaacctcatctctatatttggataacatcctcctttaggacttcttatactgattatagaggagtgtaaaatctcagcatggtgaccgacacatatctggcattcaaataaataatagacgttaaaatcattacttactagaagggcattagatacaaaacaaagccacatattagattgtatgtttttgggttgatttacaggcgctctttcattgtaactgaaatattttggaaagaacattataatacatgctgctgaggtgagatggccaaaaacgtccttcagcataaagggtcccactgtgggcagtctcatgagcagttggttattgatacattctattgagtttaatgtgaaatttttctccccaaagtggccattggaggggtccaagactgatctgtaagtaaaggctgcttttctaaggccatgttgaaactttggcccatgatgacccaatttaagtgaaagtctgagtctctcgctttgggaaaggaaacagagcataaaatccctttcaggtggttttaggaataaattctgcatgtgcctaatgtggttaacctcagctaggactggatgttgctgatgactcagatgaagcacttactaaggagagagtatggctatcaataaaaagactaggaaatgtggtcttgcaaattggcctcttggaaggtagctgaacgtgtcaccaatatcatttccctcaaagagatgttaactccatttaggaacttgggctgaatgccatctgcacaatattgtgcacaagctggaacctccagggctttagttagcctcagttggtttaattggacacattgctgttttgggtttccatcatattctcaaatatatctcctctaggcttcagccttgccttcattttcctgtgacaatggtataaataatgcaaatgtcttgatactgggaagcaggaatgagacccagatgtcagaatggaaagcacagcagtttacattggcaaagcagagcggtaaacacaatcaggaataggtgagccctggggaaaaggggaacggctaagggagaggtgtttgagagggagagggtaacctcttgaacaagggggacctattaacttgcagaggaactagaatgggaccaaggaggaaggagatgaggaaggcatgtgagaagcatggcaatctggtcctcatcagcttctttgcggagcaagaaatcatggaactcatgtttgcatgaactaaattaaccttgcaatttagctcagacaagaatgcattggaaaaggtcctaggaagatgcataatccaatccataccttcctgatgaagaaactgaggcacagagaggggaattggtttagtcaaaggcccaaagttcaaaactaaacactccagctcaaaggaaactagatgaaactacacaaagtcttcaattctgcatttcttcctatgttccttgcctttgcggaaaggcacaatcattgcctgtttacttaatctggaaatcaaggagttattcctaacctcttcctttcttagcctctaaatccattgtctctaactcctgtagattttacttctttactctcacaaaacttcttttctttatatacttatatctggtgccttaagctaggcccttctcatctcacttgcctagtctcagtccctcccatcttaacacttctgttcttcgttctaatgatctgatcatcttgctccttcttgcttagtttaaaggctccttcaccaccttcaagaaaatgtctcaacattctagaatgatgtacaagtgcattaacgatctgaccactgcccacttctatagatacctaatttattctcctttcactctaccctcttattccaaattattgttaatacctcaaatctacagatccttcttgctgttttgtcatttgcttggatagctctcactcagtaaggttcatcttatgtataacctcccttgagaatcccagaagcaccacatagcacacttccaaggtgctgctcccttggagtgcaatgtgaatgctgccccctggaagtgtgcaactgttcttattgggttcccagagaacgctgcttatctctacttcagctcttctcttatggtaatacaatgacctcttggcttgtggtataatatcaacaaatcagcttctggatggggtaatatagaaatgaaaagtgttttaaaacattgtctctgggttagggcaaactggggctccaatatttattcacacaataacaatacaaacttgggcaagttacttattttatctggaatttagtgttctcggccacaaaatgagcataataatagcacctacttcaccatgggataatctagattaaatttttagcatgctatctagagtcttcaataaattaactattgttgctattattattgttacggagagcagtgctgtgttatattaaaattttaacttctcctattacgtagcagttacccagtaaatatttgttgaatcaattgataaacaacaagatagggctattgaggtggggagcggtggctcacacctgtaatcctagcactttgggaggacaaggcaggcagattgcctgagctcaggagtttgagaccagcctgagcaacatggcaaaatgctgtctctactaaaaacacaaaaagttagctgagcgtggtggcaggcacctgcagtcctggctactcggaaggctgagccacgagaattgcttgaacctgggacatggaggttgcagtgagctgagattgggccattgcactccagtctgagtgagactctgtcttaaaaaaaaatagggctattgattaacctgtaaatattgtattgggaacagtttctgcttacctgttaaagaattgtactgaaaagaagtataagtattaaatcttatggtagaaaagaaaaagcttccttaacttaaataattggataattgccttgtaattgcaccctgcaatttgaagaaacacatgtttcttagaattaacaggcatttgttttcagggatatcgtttgagaaacaagcagaacaatgtctccttctccttcactctgaatcttctgtggctactagaactcaccatgtttattcctgcaggtgaatggctctataatttgtcgtttacttcctttttcagagtctgtaaggatcagggaaggaagaaaagctattttctccagttgaatttagtatttaaggagtgcctatcaccaaggaggcatagcttctggctttattgagaaatctgttgctaagacacagttttaatttgtttgcacacttttcataagaatggtgagtgtttattcacagagagaaactaagatgtaagaggtaaaagttggtggaaaattagtgatagtagaggattaaacctcaaacaattattttatttgttcctttagactagaggctttgaaagtaaggtcctggggctggggcatgagcatcacccggaaacttgccagaaatgcaaattcttgggctcaacccagacctacttgaatcacagaattgccagggtgtggctcagcagtctgctttaacaagacctccaggttattctgatgcttattaatatttgagacccatcctgggcaacagagggatatcctgtctctacaaaagtattttaaaaattagccacgtatggtgtcgcttgcctgtagtcctagctactttggaggctgaggcaggaagataacctgagcccaggatctcgaaggttgcagtgagccatgattgcaccactgcattctcagcctgggtgaaagagtgagactatgtctcaaaaaaaaaaaaaaaaaaaaaaaagagagagagagagagagacccactgctctaaagtctagaataggacatcatgcaaatcatgcaagcctcacgtattagtagcaatagtaactgaggagactagctttcccctgctggaaaattctgtaataacatcacctggaacagatgcctctagagactgagccaatttttttcaagacccacaacaactacctcatgttgcctcctgatctcctaactagaatcaaatatcagcatgatcctagaagataagtacatgctgttacccaaaaagaaatagcttgcacacaaaagaattacaagatttgataatatatatcattagaaacgtgggcaacatgtgtgggagtattctaataagggcagaaattcactagatttggctgacttcattgacatgagtatacaatctagaggttctaaatttaatgtgttagcttgcgcagctggaagtggatctaacagcttaattgggtggttgaatgaatgttgtgctcaacaatagtctacatttagtaaggtcaagattccagagctttgctggcataatgtaggggagagtatgcaaagtctctaggagatagaaatgtatactgagtttatcctgtttatgagagggctcagaagacactccctccatgaagcaatgagaaatacagtagtgtcttcatccttgacaaactctgtagttgttctcctttgaaggccaggtttgtaggggatgccaccattgagatttttttttttttttttttttttttttgagacagagttttgttctttttgaccaggctggagtgcaatggcacgatctcggctcactgcaacctccacctcccaggttcaagcaattctcctgcctcagcctcctaagtagctgggattacaggcgcatgccaccatgcctggccaattttttgtatttttagtagagacagggtttcaccatgttggccaggctggtctcgaactcctgacctcaggtgatctacctggctcggcctcccaaagtgctgggatttccaggagtgagccactgcgcctggcgagatggggtctttgattttatggagattatgcaatcctagagtacagaggccaagtggtagcacttaaccaccaaagacaggagggatacatcaaccatcgtatctcgctttatcccagataattcttcttgttctgatgtctactttatctgataattaatatagctactctagcattcttttgttttgtatttgcatactatattttacatccttttactttcaacctatctgtgtctttttatttaaaatgaacttcgtgtaggcagaatatatttgatctttcttatttatccaaactgatactctttaccttttaattagtgtgttttgaccatttacaataagtaagattattgatatgtttgggttgaaatctaccattttgctgttttctattttttcatgtgttcttagagcttcctatcttttctgctttctcttttattcattgagcatttttatgatcccaatttatctccacatttgaattattattcatgccccttaaaagtaatttagtgtttgccctattgtttacaatatctatctttaattaattagagtctaccttgagataacatactgcttcctctctactacaaggaccttatgacagtatataaccgtttattttctcacattttataatacgattgtgatacatttacttttacatatgctataaacatgcagtatattgctactatttttctttagactgtcagttgtgttttagagaaattaaagtcaagaaaaaaagaaaaatatattcttttactgtcgtgtgtttcatttccattcttttaatgttttgattcaaagagactgtgactttttcagaccaaaatgatctttggaccccaaacttctacatcaggaactggagaagttagaggctttgccttaaagtaggcaatattgttcaatgcccttttcatgcatggccaagaaagatacaggaaaaataagtacctcacaaggaaagagtaaatatctgtagaaaaaataatactggacaactaatgacagggagcagaaccagggtctaatcaaccaactggccctacccaaaggatacaggcatctcacaatgcctggatgaaagcattacagaattgttatgaaccagcaactgctatatccatcttattcatctcctttgaaacatgagtgttactggggatattatttcctcattcaaccattgtaggtagatgaacagaaaacaggtggcttgcctttttcttcatagataaggagaaggcatacacaggatatagaaactataatggaattttgggctgagactgatactgtaatggaatgggctctttaagtgtattttccttggagaataggtgagtgtattttgtatgtggaagggagggaaacaaatatttagactaggaggagagattattctaacacttagcttttgttgtataataaaccacagcaaaacttagtggcttaaacaaaagctatgcattatgattcctctgctctgacccaggttggctaggactggatggtctaagttagattcattcacatacctggtggttggcttgatatcagctaggtcaatcgggatgactttgcagagagtctcatcatccagcagcccagcctatgtttactcacgtgatggttgttgcaaggttcctgggaacagcaagacagcaaaccccttaatatgcctcagcttgcatcatatttgctcagtcttattgaccaaaagatgctacatagctgtattagtctgttcttatgctgctaataaagacatacgtgagactaggtaatttgtaaaggaaagaggtttaattggctcacagttccacatggctggggaggcctcacgatcatggtggagggcaaatgaggggcaaagtcacatcttacatggcagcaggcaagagaaggaatacaggggaattcccctttataaaaccatcaggtctcatgacacttattcgctatcaggagaacagcatggcaaagacctacccccatgatttaattgcttccacctggacccacccttgacatgtggagattattacaattcaaggtgagatttgggtgggaacacagccaaaccatatcaatggctaagtgcatattccagaggtgaagaaatgtactctacctattgatgaagatgaaacatagtctactgcaaagggtcatgcatacaagaatagaaaaaaagttgtggtcttttttagattttattatttttctccattattagcatctctccttataataagattttgcatcactgcccttgtcatatgatttgcagaacctccctttaggaggaacgtacttacctacaccactgataaaattggttatgtgactttctttgaccagtggactttgagcagatatgacgtttgccacgcttcagtagaagctttaatggccattacctgattctacctttgacagtttttcccctctaccacaagagtagcatgtttcaaattagggcttctttagcctggatcctagaatgaagaaaacatgcagagcagagtcatagccgatctctagtatgaatgaaaaataatcctttgtttgataagccattgtgttttgatggtcattcttttccacattggagcctagagaaaaattagagtgattgattagcttctgtttttgtatatttcaccaattcccttttgaaggatctttcctattgacttttattttaattttttttaaccttcaagttcaggggtacaagtacagatttgttgcacaggtaaacttgtgtcatggagctttgttgtacagactgtttcctcaccccggtattaagcctagtacccattagttatttttccttatcctctcccttctcccactctccacactctgaaatgccccagcgtgtgtgtttttctcctctgtgtgtccatgtgttctcatcaaattgtttaaaatactcatagatatcttaaaatgcccttgttcctattttcttttccagctttgcccattcctcctacccagtcacaagtaaatttatcaaaagagctatacatgacttgcgtttcttcgtattctattcactcctaagacccttaaagtctacattctcctctgataactccatcgatacaatcaatgccactcttgccaaagacaccagtgatccgcacatggctggtctgctaactcaacagcatccgagaaagttgacattgtaaactttctttgagccatggaacatgagtagatacgatttaagtggatttaagaaaccaatgacctgacctggttttattttctcctttgttgggctattgtaggttttctgtgacttccatggccactcccaaaagaagaatgtgttcctttatggctgtagcatcaaggaaaccttgtggcaagcagcatgcactgtgggcacatctactatcctagaggaggtcaactacagggtaagccgctgtggggaatgacatcagacatgctgtgttcatattcttcattcttacctttaagaccatgccccactcatttatttagtttttttttttttttgtaaataagcattttaattattctaaccataggattgtaatacaagcaggctggaagcatgtgtaacctctcctaatttttgttgaataatgacttactgacttgttgctttgcccctgttttctatgtggtttgatattgtataaaaggcatgagaactagagacagaagacctcatcttaatacctggctttacaattattcgattattaactgtgtgattatgaggtcattaacattacctctctgaaccacccttctgccatctgtaaaatgaggatagtaaaaatactgcctctgttacatagcttatggaaggaacacaatgatactgaatacaaaaggacttcaaataaataggaagggatgaataaacataagccattaaaccatctacatctctctgcatgagaattctataaaaagcagatcagtaatccactgaccctaattctattttactttagttttagtggttagagctcaactgttcctccatgaaaccacataggaaattagggaggggtaaagaagggagtacttcttcccatcaggataaaggcaacaagctattgcataatgagaatcaggaagaagcaaagttgcccaaacactaaatgaaaactggtctttgtttaaaatttctgtagaaaaagtagaaaattatgatggtgtctgcctctactgttattctgggtatgcaatttactatgtgcaaaatagcttcatccccagggttaatgatagtattaagaggtaaaaatccaccaagtcaccatttcacctggaaatacatcccctcttctctagccttcttcactcagtccatcaaaaatagactgccgctgatcaatacaaccaccccaaggcttttatagcagaatcaacagcttatcctcaataacctgtttgctgtaaggctcaaccagagtaatggtgataaaccataagaagcttaataacttaatcttatttaggaaactagtttagtaaattaaagcattcatctgggcagctcctgtggacccaacccatataaaatgatctcttatatgtgatacatcttgaatcaaaaaaatctaccatggtccaatcttaaatatagagtcagcatgttttttacttctctttttccaagggaaggtaataatattaatagataattccctatacacaggaaaaggtataagacacagaacctttaaaaagtctcctgtacgaagctgacatgaaatggggcagaggtcagacattgtagggaatgataggatgggttcttatcaactgtattttaatttttgtgaataattcatactgtttaattaataaattcaaaacacattttgaggcccagattagtgtcagttaaggtaaaaggcataacattatagagacaggtatgccagtttctgcctatgagaataaggacagtggtatttaatagcaatgctgttaaaaagattaatccatctagacattaatgctcacctataaggttctttaactgtgagtgggtcagttgtctgagcctcacttttctcccttgtgaaattaggaagttaaattttctacatagtttattacatcaagtttgttggtgccctgggattccttaaaggtgattcatgggctactatgacatatgtggaggtagtgaagtgaatatggtttggtcacatccctggctttcaacccaaacagctttgctttttggggtcccacatagtatataactccctctatcactgacactctaaattaggacataatgatctgtaaataattatcttaacactggtgatctgcctaaaaagacttttgtgtatacaaatggatcttgtcagaattgaaaggacccactcattttacagatgggaaaattgagactcaggggagaatgtcttggtaagataggttaatgttatcatcatgatatctaccagcagtcaagagtctgttgatgcttagaggctgattccttcattaccatcaaaagtggaacaattctaaacatgttaaacttatctaagactttatttggtcatttaccattagtattgaagagacgattatacaccctgttatatttcacatccactctgcaacatttattcagttttattaatcaactttaatggtactacttctagttatgttggtataaagaggtcagtgaatcctctctgcaaaacgcagtataaaatagaagaaaattttgaaaagcagcccttttaggactctgtaaattgaccaaatacagatgataaattgagaagcatttattcttgaaaattgctggaacttcatgtaagaacagcaggggtctgtaaccttcttgactggggctgctcctgacaccactctatgtggtcatcaagaaatgcagttttaccaacagaaggatagccacacacacacacatgcacgcacacacacacacacacacacacacacacacacagccagaaatttacaagggagaccttagaaatgagagagccacagaaaagctaagataggctctctataaatacatggtgtattaagccattcttgcattgctgagactggataaattataaagaaaagaggtttaattggctcatggttatgcaggctgttcgggaagcataatgttggcatctgcttctggggaggcctcagaaagcttccaatcgtggtagaaggtgaagggggagcaggcacttcacatggtgagaacagagccaggaaaagagtcagggggaggtgtcacacacttttaaactactagatctcatgagaattcactcattattgcaacgacagcaccaagaagatgatgcaaaaccattcatgggaaatccactcctgtaatccagtcacctcctaccaggccccacctctaacactgggagttacatttcatcatgagattttggtggggacatgtatctaaactatatcgtatggattatggaaaaatatatgtctctagaggagacccaagagggcccagtgagaaagaaagtccaaagagacttaagaactgccacaattttgaatgtcttcccaaatcacatacaaatcaatcaacagagagtggaagtcttatgcactcaagatatttgagcactacatttgcccaaattattgtataaccactaggccaagcagccacagatgtcaagctaaataatttaaataagaatgtagaaactgtgtagagacatcagtggcacacattgcagaagaaaaaagaaagaaatattctgcagattaatccaggaaagtagttaaaaatttaaaaacatttaaaaaatagaatccagagatgctaaaaaaaaagtataatctatgatgtccagtttgcaaccaaaaactacaattttgtgaagaatcaagaatgtgaaatccacgctcaggaaacaaagcagtcagtagaaacaagagtgggccaacatgttggattcataattatttccaagcaactgttaaaatatgttcaaataattaaagaaaattatgttcaaaagttaatggcaaaatatgatgaccattactcaatatatatggaaatttgatggataattagaacagaaagaaggaaggaaggaaggtaggaaagaggacaggagaggaggggaggggaagggtggggaggggagtggagggagggagggagggaggaaggaaggaaggaaggaaggagatagtgttgatgagtatcataaccaacatgaaaaattcactaggtgggattgtcagcagatttgagatggcaagatagtagagaatgaatcagtaatttgatgattaaccccaaattattcaattcaaagaacagagaaaacaagattaaagaaaagtaaacagctgtagagacctataggatagcataaagcatatcaaccaacatgtaatgggaggcccaaaaagagaggaaaataaatgtctgaaaaaatatttgaagatataatgagagaagaagatagtataggaggaacaaaacatatatgagacatatagaatcaaacaacaaaatggcaaatgtaaatccaaaaatatcaatgatgtcattaaatatgaacgaacaaaccctcattccaaaggcagaggttgtaagaccagatttaaaaaataggttcaagtatatattgtctataaatgacatgcttttgattcaataatgcaaacagcttaaaagttaaaagatgggaaaagatacaccatgcaaatggtaaccataataaagatggttatattgacataagacaaaatatacattaaaaggagaaatattactagagctaagggtgcaattcataatactgaaacaaattgttaatcagcaaggtgtaacaattataaatgtatgtgaatatatatactctgacatacaagaagaaaaagttgaaagaaggcatttaaaatttaataataatagctgaatattttagtagtcttctctcagtatgtgatagaataaccaaaaagaaaattagtatggagaacacctgacttaacttacatatagcagttcttttcaaaacaaaagaatgtatattctttttgagtgcacatcaaaatttctccagcatagatcttataataggctattaaataaatatcaatatatcttaagggactgaaaccatgcacagaatattcacctactcaagagaattaaattataaattaactttcataagaaatctgggatatctctgattatttggaaattaaacaatttgtatcaaattaacttatggatcaaagaggaaatccaatgggtaattagaaaatatctttaagtgaataaaaattaaaactcaatatgtgaaaatttatagtatgcagcaaaaatagtacacagaaggaactttgtaatttataatatttagaaatgcagaaagatctaaaatcaagaatctaagcatccacattcagaaacaagaaaaataagtgcaaataaatcccaaagtataagaaagaacaaaataaaagccaaagttagatcaatgaaataaaaatcatatgaacaatagagaatccataaagaacatgcttttcattcaataattcataatttgatttcttaaaacggtcaacaaaatgatcattatttagctagacaaagaaaagaaagaagatacaagttaccaaaattgggattgaaagaaggggcatcactacagatcttacaaagtaaaaatgaatatcattaacaactttatgccaacaagtgaatacattcttaggagaacacagactaccaaaactgactcaaggacacatggacaatctgatgaggtttattttaagtggaaagaagaattagtaattaaaactcttcccacaaatggaagtctaggcccaaatggctttgttgatacattctatcaaactcttaagaacaaaatagtgctaattataaaaacatcctttcagaaaatagaggagaaacacttgccaactcattttatgaggtctgtgttatcctgataccaaagccaaaatgagggcatcacaagaaaagacagctacagcccaatatttgttataaacagacaatagtattattcagtgctgaaaaggaatgagctatcaagccatgaagagacacggaagaaccttaaatggatattactaagttaaagaaaacaacctgaaaaggctacatactgtatttccagctgtatgacattctggagaaagcaaaaccatggagactaaaaagatcggggttgccaggagtttggaaggaaggaaggaaaaataggtggaacacaggggattcttagggcagtaaaactactttggataatactgtaatattgagtacacatcattatacattttttcaaacccataagatgtacaacaccaaaagtgaagagaatcctcatgtaaactatagactttgagtgatgatgtttctatgtaggttcagcagttacaacaaacctaccactctggtgagggatgtcaatgttgagggagtccatgcatgtacaggagtggggggcatatgggaaatccctgcatcttccttctcagtttcgctgtggacctaaaactgctttaaataaagcctttttattttttttaaaaaagagagagatagaacctatggaagaaaaaaatggtttcacttaagtaaaaaaggaaaagtcacttaaacaatgtaagagtaaacttttgcgacatggtatgccaatgttaagttaaagctatttgccagtattattgatcactttagttgcaggatatggaaacaatatatttatgtctatttgaccagccccccaggggtctggactagcagattctatttattttagcaaataattatgtagtaacctctatgagcaacatactgctcgatgtgtagggattttcctgtgaataagacacagacctgccctcatggaacttctaggcttctggggagatagaaaacaaacaactaatacatacacaataattcagttgtaattgtaatgagcactttgaaggaacaaatagatggagggattataggaagggagggacaagagtggataagatgaaatcagttaggaggcaattgtagacactcaagtgaagataacattagcattctatttcccttttttagatgattgtaagtctggaggctatgtaggaatttagagatcatagtgaattatattaattatgctaatatatttatataatatgtaatttataagatgattaataattataattaacagttacatttaacatgaggacagtaagtaccagagagagtaagagatttgctcaatgttctagaaattaacaaaactgcatctctttaaaaacaattctttcatttgtattctcattaacttgttatgcttctctactttctccctgtaatttgtctaaaagcctaaggcttcactattgtctaatgtatgtaattttatactatgtgttatttatgcatattctgccaacactaaaatgagagaatccttcttgttaatgtcataaaagttctgggactaatcgcagtatttctgctgactcagaactgtgtatactatcaactctgagtcattgtcctctggggaggaggtctagtggctggaagatccctttctgtcaatcagggtgtcaagtgtctagagatgccttctaaatggagattaagtagtcataaataaaatatttttaccccaagaaaaggtggaacatatgaacccagagaggatggattttcaggagtttcatattgatcaagcctcagatttttggcttagaagatgagacgaaaaagatcattctggcaattatatactcttaggaaagaagtgaactatatgtgcttcttctctagaatcatcactggcccctttggccttgtgaaataagtgaacagtccctagtctgaccctgctaagtaacagtgaggctggatgtagtctgtaaatttcaagtccctttgaaatctgaggatttccgtagtctcaactctttcatgtatgaggccaaatgtatgtgtgcagccttggtccatagcaatacaggaattgaaagattatggagttggccaggttggcatttggattcctttctagcaactttatggttttctggacttcagctatttatttctaacttttttttttttgatatgctgtctcactctgtctcccaggctggagtgcagtggcgcaatctcagcacactgcaacctccatcatctgggttcaagagattctcctacctcagcctcctgagtagctgggattacaggtgcctgccaccacatccagctaatttttgtatttttagtaagacggggtttcaccatgacggctaggctggttttgaactcccgccctcaggtgatccacctgcctcaacctcccaaagtgctgagattacaggcatgagccaccgctcctggcctatttctaccttttctaagcctgtttcctcatctgcaaaatgatttttaaaaagtgatagccatttcttagggttaataaatgatttaaagtaacgagtattttatatatagatgcttaacaatgttgagaagctatttttatgatgactatccctagtcacccacaactaatcatcgtttgatttttgtttttactgtagactcttcccaaaatccttgataagctagcaccagcattcacaatgagcagctgcagctttctcgtggagaaatctcgagcttccacggcccgggtggtggtgtggagagagatgggggtgtccagaagctacaccatggaaagcagctactgtggctgcaaccagggcccttatcaggtatgtgaggctgcaggacacccatactttctgtccagcaacaatacatagaaattatagacagctcgtacctgctttctcacctaaaaggggaagaaggctccaagtagagtttggtcctcccttgccttgaaaaacgggttcaacaattgctttcacctgcaggatcatctatcttgatcctggaagcaatgcgtgcatgctttccaatttggttcctcaatcagctgccctcactagcaagcagctgggagcctctctttgacatgcatccccaacttttacagaacctctgcttgcctggctctgttgttatatgcataaaattcttgccttctgcaacaagtggactagttctatgtacatcataaagggcataggtcagtgtgtagatattgttggtacatatatctattgtgtttccatcttctgcgtcaatctaaatctgtagttctctttgttatcctgctgtctccagagcacacaaaagtgtgtgcatggcgtgggtctcccagaatgagtgggttttggactcatatgctagtgttgagagaaagtgctcttgtataaatcacattctttctacagctatattaactgcatgagcagctggatagctgctacagcaggctgttctggctgcttttcccactcccccatagagaagcataaataaaggacattttgacagtgccagggtaatagactcttgtaaatttcttaggcaagctgacagactgctcctcggtgacttccattcaaccctaagaatacctggacctccccagcattaagctcattgtgttggctttgatagtctcctggaacagctaggaagcacttggcatctatgcaatcctgagcttgtagaaatctgttagttaccaaagagagtacagggtgtgacaggcaatgcacattatctaacttctcatgtagtcgaagattttttttaactcagagctaccgaaccacccttttgactattaattctgtcaaatagccacttagtctaaagacttgtttcaaataattgttttgttactgaattaataaattcttagactgaattaatcctattcacccacattaatgtaaaagaagaataagaagagctgaaatcattggatgagtctgagattgggcatcaagagatctcactctttcacttaccagcagtgttgaaagctacttacttctaggaacctattttttttcatatgtcaaatgcagattttaataaggactccttttatcctaccgtacaaggttttgtagggactaaaagaaaacatatatgtgaatatacttggaggttatataatcagaaatctgttcactcccttgtcattcaaaacgtataagattggaaaaaaaaagctttaaatattgtgactttaaggccttatggacataggtttgtgtctctctctgtacatgtgtcttgatgggaaggggcttgtcatttgtttaaaagacaactccatgtaactcttcaaagatttattagcttgtgactgtcattgagtttgtttctccaagcaccaattcaaacaaacagcttctagtcacgtaagtatcagtgccattcacaataaatcagctggaaactcaaagttctctggagctgtttgaaaatgaaatgactcataggttcaggccctcaccaactctctactgtgcagtgtacacagaggctgttggagaggacaaagaatgaaagggctcacccagtggatggccttcaggtattggagcagcatttatcttgtgaaattttccaaatggcttttgcattgggtcactagaaggaataatggagggagaactggctagagaaagccctaacagtgccagacctggttttggtttaagaatcccattctctatatgaaaaacacttctccgaatgtattagtttcctccttctctttgttttcctgtccttacaaacattgttgagtaactgagcagaatcacaggcagtgatactcacagaggatggtgagtaattttacatatgggggggcccaccccatgggaaggaagccagcctggagttgggtgttttggtgatttttgcgtaaggtacataatgcagtctatgagctacaaagcagtatagaaatttccatcctgaacatattgcaaatgctttttgtacattgggaagctgagtcccagttgagtcttgagattattattctaaggtcatctttccattttttgtttagcattaccatttatccaaaagatggaggatacttaaatacacccgtgagaggcattctttccttccttcataagaatgtaaatatttttgcagtttctctggttaatgcagctttaaagtagttccaatcatttctcccccagcacactaagtacctgatttgtaagtattgaaatgaaatatcattctttacagtgacatttatattggaactgcattaaagaacataagctattaccttaaaataatgattattaatacgatatttcctcttctattttccagtctatagttggctaattagaaaaagaattatcctgctcttgtttctttgggatacagtctctgttgctaggtcatacacttagatctataacttgtatttaatgtggaaatcccacccactgagagatttactttacctattagggatgggcccaaagctattgaggctgttgaggaaaaagccaaaatgaaatgatgcatcctttgggggctcatttttttagaggcatcccgtccatgtggacagctgtgggcttcacactgagtgtttgtgacctgaggtcacacacgtggtgtgtttgcatacacaaaggcatgtggctgggccccaggggttgctggtagcttaggaggaggatgtgagtccctttacccaagcaggctgtcagcttgctccttgcaacactgctaacttggacagcaaagtggatcttaaagaaggacagaagatggtaactcagctgaggtttgaagagtgactcaacttgtgtttaaattctctacctgcgagctgcatccttgtattgtgggaccttcctgcagtgcatcctttctaccacccacaagggctcctttaataacacaaatctattcaagtcacagtaatgcccataagtgtcttcattgtgtctcgataaaatccacctcatcatcgtggtgagtaaggccttttacaatctcttctttcttttttttatactcaatgcttagtatagtataaagtaggtattaaaaatgtatgatggctgacaagtgagtaagtaagtgaacaagtaaataaatggcaatttccaagccctcaaatgatgatcctcactgtccttgggtaagtagaaaaagagaagaaattattgtggtccaaatgtgatcagatgccattctgaaatggagatattaagagtcgttgcaatgggtagagctggaaaatgtgtgggtgaaagaaggaaagacacaagaatgcagggctgagatctcttagacctgccactagatatggtttgagagacaataatccacccaatggattatttcccagagtaaggcaattctagttcaggtatggaatctcttatggacacattctaataacagatgataattaggcagaaagacttccatccatatacgtagtagatgctgcggtccaccctcgagatccctccttaggacccaggcactcaatttcccctggttgttcacagctgtgtctataaccaggaattgcttgtaactaaaggaccccatcttgccccaaagctatggctcctccctacctgcagcctacatccaatagctgatctgtgggaaaacaaaagccttatctctgcttcagttgggatgactccaaagggccattccagctctagatatccctataggattagctggcacctctgttgtaattcccttgtggttcaacctccccctctgcccaactttgtttccctagtaactcacaggtattgttacagcaagcactccccagaagtccttctgtatgcaaatctcagcatctcagaggctgtttcctgctgtaaacaacttataacagtatttcaaaaaggcttagattataaaacatgcatgctggaactaagcacttaaattgttggagatggtttagtggggatgagtttcatataggaaattcaatcatcggaactccgtgttcagggctcccagtggccctttattcactccacttgccttagctgtttagggaacaaagccctctactacaaaactagagaccgcagatcagagcagggtttcttgcagtagcccagactgtaggctgactgtatttattttctgtggctgctgtaacagaataccacaacttggatggcttaaaacaacataaatctgttctctcacagatctggaagataaaagcctgaaatcaaggtgttggcagtgttatgttctctctaaaggcaactgtttcgtgcctttctttgagcttcttgtattgccagaaatccttggtgttttttggtttgtcaacgcatcactacaatttcttcctttcttgtcacatggccttctctacctgtgaacctctatctctgtgtctcccctcttcttcttataaggacaccagacatactggaataagagcccaccttactccaggatgacctcatcttaacttaattaattatatctgtagtgaacctatttccaaataagctcatattctgacattctgataaggagataaatttgggcattgggcaagatactattcaagctaataaactgggtcacacaagaaaacacaaaattatctccaagaattagggaaggtttttatttctgtctccatattgccatgtggtaaagccctaaatatgttataacagttcttattttctctccacctcatgatgaggaaaatgaaaagtttcagattttcttggaacatcttggaagacaaatttgagactcatggcatgtatgagtgctgattaaggctgctccagtattataatacacaatgttaaggtagcaataatgataacaaacacatctatcatacttattgtgtgctaagccctttacatatcttaaattacttcatgtctgctattgtacaacaaagcactacaaaatcagtttcattattattctcattattcctattttacaaatgagaccactgagacagagaagttaagtaacttgctcaaggtcccacagctagaagttttctgagccaggatttgaagccagacagatatgttgctgggatctttgcttttacctcgtgctttctgtctagtagaatgtggttggtaaaaggggacctgggctttggaagcaggagacccaccttctgcacttggctgtaattaagcagatctgcagcaacaggtgagccacttaacctctctgggtcacaattttcttatttataataggaagacagaattggaactaaaagataggtgtggtttctgctacattatgttgaccaagttttttgctgggtatccaagggacttatggatcacccagaccagggtgacccagtgtaatgtgaagcccttaaaaattttatgcaatttttcttttttttcttgtacttttttttttatatactttaagttctagggtacatgtgcacaacaggcaggtttgttacatatgtatacatgtgccatgttggtgtgctacacccattaactcgtcatttacaatagggatatctcctaatgctatccctcccccctccccacccccgcaacagtccccggtgtgtgatgttccccttcctgtgtccaagtgttctcattgttcaattcccatctatgagtgagaacttgtggtgtttggttttttgtccctgcaacagttggctgagaatgatggtttccagcttcatccatgtccctacaaaggacatgaactcatccttttttatagctgcatagtattccttggtgtatatgtgccacattttcttaatccagtctatcattgatggacatttgggttggttctaactctttgctattgtgaatagtgccacaataaacacacatgtgcatctgtctttatagcagcaggatttataatcctttggttatatacccagtaatgggatggctgagtcaaatggcatttctagttctagatccttgaggaatcgccacactgtcttccacaatggttgaaccagtttacagtcccaccaacagtgtaaaacagttcctatttctccacatcctctccagcacctgttgtttcctgactttttaatgatcgccattctaactggtgtgagatggtatgtcattgtggttttgatttgcatttctctgatggccagtgatgatgagcattttttcatgtgtctgttggcggcataaatgtcttcttttgagaagtgtctgttcatatcatttgcccactttttgatgtggttgtttttttcttgtaaatttgtttgagttctttgtagattctgaatattagccctttgtcagatgagtagattgcaaacattttttcccattctgtaggttgcctgttcactctgatggtagtttcttttgctgtgcagaagctctttagtttaattagatcccatttgtcaattttggcttttgttgccattgcttttggtgttttagacaggaagtccttgcccacgcctatgtcctgaatggtattgcctaggtcctgaatggtatcacctaggttttcttctagggtttttatggctttaggtctaacatttaagtctttaatccatcttgaatgaatttttatataaggtgtaaggaagggatccagtttcagctttctacgtctggctagccagttttcccagcaccatttattaaatagggaatcttttccccattgcttttgttgggtttgtcaaagatcagatggttgtagatgagtggtgttatttcggaggcctctgtgctgttccattggtctatatatcttttttggtaccagtaccatgctgtttttgttactgtagccttgtagtatagtttgaagtcaggtagtgtgatgcctccagcttcgttcttttggcttaggattgtcttggcaatgcgggctcttttttggtgctatatgaactttaaagtagtgttttccaattctgtgaagaaagtcattggtagcttgatggggatgacattgaatctataagttaccttgggcaatatggccattttcatgacattgattcttcctatccatgagcatggaatgttcttccatttgtttgtatcctcttttatttcattgagcagtggtttgtagttctccttgaagaggtccttcacatcccttgtaaattggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcaggttaaggagattttgggctgaaacgatggggttttctaaatatacaattatgtcatctgcaaacagggacaatttgacttccttttttcctaatggaataccctttatttctttctcctgcctgattgccctggtcagaacttccaacactatgttgaataggaggcatccctgtcttgtgccagttttcaaagggaatgcttccagttttcacccattcagtatgatattggctgtgggtttgtcataaatagctcttattattttgagatatgtcccatcaatacctaatttcttgagagtttttagcatgaagggctgttgaattttgccaaaggccttttctgcatctattgagataatcctgtggtttttgtctttgcttctgtttatatgctggattatgtttattgatttgcatatgttggaccagccatgcatcccagggatgaagcccacttgatcatggtggataagctttttgatgtgctgctggatttgctttgccagtattttattgaggatttttgcatcaatgttcatcagggatattggtctaaaattctctttttttgttgtgtctgtgccaggctttggtagcaggatgatgctggcctcataaaatgagttagggaggattccctctttttctattgattggaatagtttcagaaggaatggtaccagctcctccttgtacctctggtagaatttggctgtgaatccgtctggtcctggactttttttggtggataggctattaattattgcctcaatttcagagcctgttattggtctattcagggaatcaacttcttcctggtttagtcttgggagggtgcatgtgtccaggagtttatccatgtcttctagattttctagtttatttgtgtagagttgtttgtagtattctctgatggtagtttgtatttctgtgggatcggtggtgatatcccctttatcattttttattgcgtttatttgattcttctctctttttttctttattagtcttgctagcagtctatcaattttgttgatcttttccaaaaaccagctcctggattcactgattttttgaagggttttttgtgtctctatctccttcagttctactctgatcttagttatttcttgccttctgctagcttttgaatgtgtttgctcttgcttctctagttctttcaattgtgatgttagggtgtcagttttagatctttcctgctttctcttgtgggcattgagtgctataaatttccctctacacactgctttaaatgtgtcccagagattctggtatgttgtgtgtttgttctcattggtttcaaagaacatctttatttctgccttcatttcgttatgtacccagtagtcattcaggagcagcttgttcagtttccatgtagttgagcggttttgagtgagtttttaatcctgagttcttgtttgattgcactgtggtctgagagacagtttgttataatttctgttcttttacatttgctgagaagtgctttacttccaactatggactaagtacgatgtggtgctgagaagaatgtatattctgttgatttggggtggatggttatgtggatgtctgttaggtccatttggtgcagaactgagttcaattcctggatatcctttttaactttctgtcttgttggtctgtctaatgttgacagtggggtgttaaagtctcccataattattatgtgggagtctaagtctctttgtaggtctctaaggacttgctttatgaatctgggtgctcctgtattgggtgcatatatatttaggatagttagctcttcttgttgaattgatccctttaccattatgtaatagccttctttgtctcttttgatctttgttggtttaaagtctgttttatcagagactagggttgcaacccctgccttttttgttttccatttgcttggtagatcttcctccatccctttattttgagcctatttgtgtttctgaacgtgagatgggtctcctgaatacagcacacggatgggtcttgactctttatccaatttgccagtctgtgtcttttaattggagaatttagcccatttatatttaaggttaatattgttaggtgtgaatttgatcctgtcattataatgttaactggttattttgctcattagatgatgcagtttcttcctagcatcgatggtctttacaatttggcacgtttttgcagtggctggtactggttgttcctttccatgtttagtgcttccttcaggagctcttgtagggcaggcctggaggtgacacaatctctcagcatttgcttgtctgtaaaggattttatttctccttcatttatgaagcttagtttggctggatatgaaattctgggttgaaaattcttttctttaagaatgttgaatgttggcccccactctcttctggcttgtagagtttctgccgagagatctgctgttagtctgatgggcttccctttgtgggtaacccgacctttctctctggctgcccttaacattttttccttcatttcaactttggtgaatctgacaattatgtgtcttcgagttgctcttctcaaggaatatctttgtggcgttctctgtatttcatgaatttgaatgttggcctgccttgctaggttggggaagttctcctggataatatcttgcagagtgttttccaacttggttccattcaccccatcactttcaggtacaccaatcagatgtagatttggtcttttcacatagtcccatatttcttggaggctttgtttgtttgttttcactcttttttctctaaacttctcttctcccttcatttcattcatttgatcttcagtcactgataccttttcttccagttgatcgaattgcctactggagcttgtgcatctgtcacatagatctcgtgccatggttttcagctccatcaggtcctttaaggacttctctacactagttattctagttagccatttgtttaatctgttttcgaggtttttagcttctttgcgatgggtttgaatttcctcctttagctcggagaagtttgatcgtctgaagccttcttctctcaaatcgtcaaagtcattctctgtccagctttgttccattgctggcgaggagctgcgttcctttggagggggagaggcactctgatttttagaattttcagctttcctgctctgttttttccccatctttgtggttttaactacctttggtctttgatgatggtgacgtacagatggggttttggtgtggatatcctttctgtttgttagttttccttctaacagtcaggaccctcagctgcaggtctgttgcggtttgctggacgtccactccagaccctgtttgcctgggtatcagcagcaggggctgcagagcagcgaatattgctgaacagcaaatgttgctgcctgatcgttcctctggaagctttgtctcagaggggtacccagccatgtgacgtgtcagtctgcccctactggggggtgcctcccagttaggctactcaggggtcaaggacccacttgaggaggaagtctgtccgttctctgatctcaaactccatgctaggagaaccactactgtcttcaatgctgtcagacagggacatttaattctgcagagatttctgctgccttttgtttggctatgccctgcctccagaggtggagtctacagaggcaggcaggcctccttgagctgccttgggctccacccagtttgagcttcctggcagctttgtttacctactcaagcctcagcaatggtgggtgcccctcccccagcctcgctgctgccttgcagttcgatctcagactgctgtgctagcaatgagcgaggctccatgggcgtgggaccctctgagccaggcgcgggatataatctcctagcgtgccatttgctaagacattggaaaagcgcagtattagtgtgggagtgacccaattttccaggtgccatctgtcacagcttcccttgcctaggaaaggaaattccctgagcccttgcacttcccaggtgaggtgatgcctcgccctgctttggctcacctcgttgggctgcactcactgtcctgcacccactgtcctacaagccccagtgagatgaacccggtacctcagttggaaatgcatacatcacccgtcttctgcatcagtcacactgggagctgtagactggagctgttcctgtttggccatcttggaaccctaatttttcttgagtatgcacatttttctagggagaaagtgctctgcttttagaaccaattaggtagttttcaagtgactttggctgttctatccactatttccccctctccttttcattttattcttgctggtctttatttcacctttctagagtatacaaagagggctgagaggaatgtaatacattaagtggcagctctccatcagcagggtgaataaggagcagagtagatcttcagtgaaacagccaattttttttatagcagggaacctcctaggttgcttccttttctcatttcacttcctcttgacttctctccttgtctcatcagagaaccatggctctcacacagttctttggacttgcgcagcccagatgggacacttctcctccctaaaagtgtcctgagctgcagaattgcctctgtatcaggatacagacacacacacacacagattctttctctccaacacacaagtatatgtatatatcacacatatatacacaaacatgtatccatatcaatggtttttaataatagatgtatacaggaaagcagagtttattgtttaatatgggctcctgtgtcagatgtagagttccagggagagctctacatttcacagttgtgaccttgagacagttcctgacttttatgagctttagtggtagacatggtgctcctcatagttcctacttcatggagatgctataaagactgaatgagctactgcctacaaaacatttatcaccattttcatagtaaaaactcaatacatgtttactgtttgtatttttattgattaacaggatcattaatggtggttttctttttctattttagataaagacacttaggctccaactcttaaccataatcattttattccaaccttcctaattagaaactttggggtctaagattaagactctaagcttttatgaagtgtaatatacagccagggttgagaaccacagattttggctttcatagacactaatatccatatacctgtatttataggcttagctacatcaaagtaatgtctatatgtatcatttagacatttcttttattatccactcatttattctatctgtcaaaattcctgtgctgcctaatctatgttttagttaatttgtatgtgaagtcccagagaagggaaggggaagaagacaatttgtgagccttcttctaggagaagagaaagaaaggcatgaagagttgaggcagggaaggaaacagatttaaatttctccaagattgctgaatttaaaaggctattctaattatgagcacaactcaaaaatattttagatcactattctcagaatcatttttacagataacctttagaggaatataattttgatcttttttttgatctttgaatgggggaggaggtgtctttctttcattaatgtaatctgaggagagattgaggaccacctcaaaccttagtgtgcatgagaatcacttgtggagtttagaaattgcaaatgtttaaattgcaagaaagtctgaactctgtgtccagaggtatcttgatctggggcatggtccaggaatctacctttttttcaagtgtccccggacattcagagcccagctgcccagagaccagttactgagagactgaggcaggatagtcagaccagatgtaaaaggtgagatggttttgagacaagtttttgtttttcttctcttgcttctgatcttctttgggatagaaaattccccatggcttttgtcatgaagtctcaaattctccttatgctcccacttttactttttttttcttcatccatgcttttaggtaattagcttaattctactacaagaaactgtctaatatcccattgagagtttaaagatgtctttgtttctttgttttctctagctcctgggacactcccaggtcagggtattttaaatcagtatctttgaacagtcttcgtatgtggactttcaagagtttaagaacagatatatataaaattatttgttggctctgtgtaagttttctggggagaatacctgtatttctaaaggtattcttaaaaggatgagcaatgcccccaagaagattaagagatcatgccttaacttattgattccaggatctctagagggcccttcacagtctcctagtttttgctcttaaatcagctcagaagtgcttggcttgactttgtgaaaatcaaatggaggctgtaaatccctgactatttctgcctacttatcaattagcacaagaagaatgaagcatctcattaaatgtgtattggattaagcagtctaaatcttctgtgactgcatgggatgctaatcttcttaggatgctctgtctcacaagtggtggtatagaccctggagcagagcatcagcagcatctgggatttgttagaaatgcagactcccaggccccacctactgaatctgcattttaaccagatctccaggtgatccatttttcccataaatttgagaaacatggattttgaacacccttggtcaaagaggtgaggtagattggaaagagtgaagggtcaagcataggaagttggggagctccaacttttctgttaaggcaaggacattgttcccagaaatttttttaatgacaatgagatgctgtatgtatgataaatatgatttaaaagttgaaaataaataattcctagtatgagatactttgttgatctatgccaacattttaatgttacataaactgtttttttttttcactcccatattctctaatacctttcccttctcaaagtcttggaaaagaggacaattttccaaatgcctgttttgccattggaatgccattttatttctttgaaaatacaaatatgaaatccagatgctgctgggcgcaatggctcatgcctgttatcccaacaatttgggaggctgaggtgggagaatagcctgagtccagaagtttgagaccagcctgggcaatataggcagacccatctctacaaaaaaaattaaaatcagccgaccatggtggcacgtgcttgtggttccagctacttggtaggctgaggttacggtgaactgagatcatgtcactgcactcccaggcaacagagcaagacctgtctcaaagaaaaagaaaacaaggaaaaaaaaaaaaagagagaaatccggatgctaatctatcattttagtagaaatactatttgggccatttatgttgacactctgtcattccttattaactgcaattcaagtgatgccttgctgttgtctcttttgttttgtttttagaaaaacttcttcggatatgatctcaaagcacactatgagcagtttattaactcactgcagtcttaattatgtagtaaaatattgtcctcattctgttaccctcagttctataatgtctgtcagcatcatgatagaatattaaaaggaattaaataaaaatcaagaggcagagatgctaataaggttgccagcagggatctttcctgggattagaaaagccctgggaaccatgaaatttaaacgcccatcgtagaaaattgttccttctatgaaaaataaggaggagatctggcacttgggataatcctatgagcctcaaaagacctatgatcttttaaaaataatttgacttcaaatgacaaagaagaagaaaagatggtttatctctgtaaatcttactctcccatgtgactgttgtaaatgcataagccagatactcttaaggaacagacaaacaaaatcaaagaaagcattgacttaatccagagttttatttatcttgtcgtgtagggaaaaaggattgactcaacctgggatgcttggagtagcatttccatacaaatgttctgagaagggcagagtccaggatatgaagagttgtcatggggtattctctctgcataaaatggggtgcaccccaaaccataatatcccctttgactattgataccagtgggctgggggaggtccccaaacactggtaggaccttgaacccagctattgtccaggctcttgacaccatcgtgagaaggaattcaaggatgagtcagaaaataggggaagtacagagatttattgcaaagtgaaaggtacaccctcaagaaaggggaggacaggcacactcaagagagagtcatgtgcaaagacatttacagctgctacctttatgggtttttctttaatcaaggggtagaatattcataaagattcctggaaaaagtgggaatttctcagaattatgatgccacccatttttacaccaaatatgggtgttccccgaactgtcatggtgtccatgagtgttaatatgttaatgagcatataatgacattctaggagaaacctaggtcaaatccagcaccatgttggatctagtcggtcttagcgagcttggtccacaaactatttttcagggtctttttcagccccagcttgtgcagctatttcaggtttccttttgctattcatgtttttatgggatctttggggtgtcgcttttctggctggaaacctctgtggctggaggcatctttgcccaagttttgcttgggccctctgggcttgttccgctcactcgacctggcaggctggacttggctcatgctactggcctggatcccatgcctgccaagggagagtcaagcatggagcagtgaggggtgtgtgagcagcatgcgggctggcctgtgagcagtttgtggtctggccgttgcacagtcagacacgctggctgatgctatagggtgggcagctccaggtgctggcatggacacgggctcttggccgagctgtggctggaccggctacaccacaagcagcttccctggctggcactggggaatatggtggcaccctgaagtttggagatgccaggaactgctgggggccccaaagatggagtcacatccctggcccagggagctcccaggtctgagatccctgaagggccacagctcttctcttctgctcttcactcccaacatggcaagcaaggggcatgtttcaaccctgtttgtgttacagatctttcagcctcaccattcagcaggtcccgagttcttgttttgcatccaggaagaatgaggttcacagacaagtggaggatgagcaagatgaagaggagcgttattgagcaatggaatagctcagagggcccacagtaggcagctcctctccatagtcagggtgtcccaacaagtgtgcagctcttagtagagagggtacttgctctctgcagctggttgtcccattgtttcttcagctcacagcaaagagggtggttcctctctgctaggcaggtcatcctgatgagtgtccagctctcagcagagaaggtaattcttctctgcagctggtcatcccttcatctcccccttgtttcctatcctctctgtcctctgctcaagtcaagggatggggtgtttattggcctcagaggggaggaagcgggtgctgattgatccatgagcagccatgggtgggcccaggcaaaagcaccacaagctccccctctggtctgggggtctcgtggcccagcccccaggcttcaggccctccctggcttaaaggtggggcttcactagggacctgcctccttcgcccaggaaactgcctcctgccgctgttctccacacccaggctgttcatgctaagggaagcctgaaggccagcatcagctgtcctcagcacccccttagcctccctcccatgcttgttggtgcacaaagtcctgagggggccaagccggcaggcgtctggcatgtcagctctaccccgactgtgtgcatatctggccaggctgtgacattgcccaggctcagccctgactttactctgagattggagtgggcgttgacagcggggagaaggcaggcagtgggagcaggcacttccgggcccgcagggggaagtgccggctcccttcctgggcccccaagaacagagatgcccgggtcctgagccatggcagggaggctgcagctgcacctgtggagctcccgctctgccaaatcagaaggggcgaggctctcacttgtccctggttcccgctggctccatggagtgtgcagcccagaccacacctccttgcagtctggggtgggggctccaggtcctcgctgggtccccctctgagagttcctctgtaccataccgtgctgctctcctgacggctggcagctcagcccggccccatcgtggcagttgccggggtggcaggctccaggaggctcccagaggcaggctctggagactgtccgcctcctgcctgcaccgttcccgcagtggtggttggtgagagcagcaacatggggacaggggccagagctgcggaggctctgggcctaggagtgggtcctgcccagtcacgcaatgttgggggcggtgcagtcggctgcctcagggtacagggcacaggagtccgaccatcgccacagctgctcccgcagcttctccagctgccaccgcctgcgcttcgctgcttcagccagcatgatggcagtggctgctctggacggcccgcccctgccatcagtgtggcactgctgcctggaattttctattctcctgtgactgccctgtattatttctgtctcactgtaagaggccaatgacggttcaagtcttcaacattcttcaccatttctgcaatctaatagagcagccttaagaatcatctctatttctaacagtaagcaataattctgtttatatgcttgtgttccctaaatgtaaatgagaactttttagaataccttgaatcctgttgttggaagccaataattagaggtttttatataaatgtttgtttcatcaattagtcaacatatatttactagttatctactttgttttaagctgaagtttgtgactgggtttatgtatatacaactaaaagcacataaccaagggcagataatagccatttcatctacattcttcattcattctttcttgcattatccattcaagaaacgtttttctttttaaatcctgcaatatgttaagtgccaagaatatgacagggagtagaactgacaacttccatgtcttctacagtttatagtccagccacaaaggcagataattaagtaagcaataacagcagagtatggaaagaagtgggtgccataagagaacacagaagaaggagatgatgatttaggcttccggaaatgttggttgtgtatgtgtgtgtgtatgaaactggaaaaggtaacatctggtaaaatagaagataattctttgaaagtagggcagggtcaggaagtccttgatttttcttttatcctagttgtctttcatcctacttcctcctcctttcgtattctaatctccccatagaactgcatgctagggtatgcatcctgctggatctgagtccactggagtatgtaagaacatgatcctcctccttattccaacatgccctctttaggagcatgctgaaatgtactgctggtatttctatgaagcttataattaactacacctccccgaaggcagacagaatcggaaagatacaaaatgtttcaaactcctcagactgataaagagtagtaaaatttaaatagggcccatcttaattattttgttccaaatgaaattctggctatctacccccaagtattcctgaaaacaacaaaaatcacaataataaaaatactttcccttttcaaaatgatgtatagtttacaaaacattttcataaactttattttctcagataagccagaaaactaccagcgaccaaacaaataaacaaacaaacaaaaaaaaaccataaaagtgagagacagggcaatggaaaggaatgcagagtgttgcattgctgcaatggtcaaagcagtcaaggaggtccactcagctatgtgggctattgctggataggctgtacatagttgaaaaggaaggcgagagcatttatctgcatgctgtgcaccaccctaccttcctgtttcctgttagtccaagtgtgtacccagaaggttaaactgacatgttcaggttgcaccatctggtcccttctgcagccactcatccaagtccagaaatggtgggagaagccagaaacttgaggtggaaggatggttggctttgctctctagtagcagcaaagaagaaggtccttttaggaatttgactggtcagtcccaaggggtgcaacaagggcccaacaagaactggtggcacctaaggcaaagttcacaactggggatccaggagctgacatatctgaaggaatctaaggagatacataacatatgttctatacaattcttaaaagttttaattttttttttttttttttttttttgtgatgaggtttagctcttgtcacccaggctggagtgcgatggtgtgatctcggcttactgcaatctccacctcccaggttcaagcgattcttctgcctcagtctcctgagtacctgggactacaggcaagcaccaccactcctagctaatttttgtatttttagtagagacggggtttcaccatgttggccaggctggtctcgaactcctgacctcaagtgacctaccgtccttggcctcccaaagtgctgggattatagatgtgagccactgcacctggccctaatgtttttaattataaaagtgattgcatggctgggcgtggtgactcacacctgtaatcccagcactttgggaggctgaggcaggtgaatcagagggtcaggagtttgagaccagcctaaccaatatggtgaaaccccatctctactaaaaatacaaaaattagctgggcatggtggcaggtgcctgcagtcccagctacttgggaggctgaggcaggagaatcgcttgaacctgggaggtggaggtgaccgtgagccaagatcacaccactgcactcctgcctgggtgacagagggagactctgtctcaaaagaaagaaaaaagttattgcacatgggctgggtgtggtggtgcatgtctgtaatttcaacactttgggaggctgaggcaggaggttcgcttgagcctaggaagtcaggaccagcctgggcaacatagtgagaccttgtctctatcaaaaaatcaaaaaattagctaggtgtggttggacccacctgaggttttggctacaagggaggctgaggcaggaggatcacttgagcctgggaagttgaggctgcagtgagccatgtttgtgccattgtagtccagtttgggtaacagagaaagaccctgtctcaaaaaaataagtaaataaataaataaaaatttgaaaataaaagctaaagcacaaactagccatattcaaattttaaaattcatgaacttaaaaaaaaattatttttagagacaagatctctctctgtcacccaggctggagtgtagtagtacaaatcatggctcactgcagtcttgacttcctgggctcaagtgatcctcctgcctcagccttctaagcgactgggcctacaggtacacaccaccacatctggcttatttattgaaaaaaaaatttctatagagacagggtcttggtatgttgcctaggctgatctcaaactcttcagctcaagcagtcctcccaccttggcctctcaaattgcttggattacgtcttgagccaccatgatgggccttcatgacctttgactctgaaatcttccagaaatttaattccagaactacacaaacatacatatacaagaaagtcattgcttgttagtgataacaatgtgcaaacaagcttaactcccataagtagaaaattagtgaaataaacaattgtctgaacattggatgactcagaaggaagaagataattaatatttacatggactttagcatttctgcatgctaactccatcatttattgactgcactttgggtaaattatttatgcttttaaaatttttagtgtagtcatcagaaagaaaagggggctaatgattgtacctcctgcagagtacatgtatataaagcacttagagtgttgttaaaagaaaaacatcagacaaattaaatttagtaaaatttaattgagagaaaaacgatttgggaattgggcagcctccaaaccagaatggattcggagagacttcagcacaggcactgtcactgaaaaaaaaattatggacagaaaaaggagatgtacagaaaatggaagtgaggtacagaaacagctggattggttatagcttggtgtttgccttatttgaacatggtttgaacagttggctgcctttgattggccgaaaccagccaaagtgactgacacaagagtaagttacagtctctttacacatccagttaggttacagttcactatatacaaagaggtctttaggctgcacttgaaatacctaaggaggcagtgatatagtttggctgtgtcctcacccaaatctcaccttgaattcccatgtgttgtgggagggacttgatagaaggtaattgaatcatagggacaggtttgtcccatgctgttcttgtgatagtgagtaagtcttatgagatctgatggttatcgtaaggaggagtttccttgcacaagccctctctctttttgcctgctgccatccatgtatgacatgacttgctgctccttgctttccaccatggttgtaaagcctcctcagccatgtggtaaccgtaagtccaataaacctctttcttttgtaaattgcccagtcttggatatgtcttaatcagcagcatgaaattgtacagtagattggtaccaggaataggattctgctgaaaagatacccaaaaatgtggaagtgactttggaactgggtaacaggcaggggttggaacattttggagggttcagaagaagacaggaaaatgtgggaaactatggaacttcctatggacttgttgaataggtttgcccaaatgcttatagtgatatggacaatgaagtccaggttaaggtggtctcacatggagatgaggaccttgttgtgaactggagcaaaagtgactcttgttatgttttagcgaagagactggtggcatttttcccctgccctagtgatttgtggaactttcaacttgagagaggtaatttagggtatgtggtggaagaaatttccaagcagcaaagcattcaagaggtgacttgggtgctgttaaagacattcagttttaaaagggaaacagagcataaaaatttggaaaattttcagcctgacaatgtgatagaaaagaaaatcttattttctgaggtgaaattcaagacagctgaagaaatttgcataagtaacaaggaaccaaatgttaatccccaagacaatggggaaaatgtctccagggcatgtcagaggttgtcatggtagcctctcctgtcattggcctggagatctgaggggaaaaagtggtttaatggaccaggtgggcccagggtccccgtgctgtgtgtagctatggacgtggtgccctgtgtcccagtcactccagctgtggctgaaaggggccaacatagagctcgggccatggcttcagagggtgcaagccccaagccttggcagcttccacgtggtgttgagcctgtgagtgcacagaagtcaagaactgggggtttgggaacctccgcctagatttcagaagatgtatggaaatgcctggatgcccaggtagaagtttgctgcaggggcagggctctcatggaaaacttctgctagggtagtgtggaagggaaatgttgggttggaacccccacacagagtccctactggggcactgcctagtaaagctgtgagaagagggccaccgtcctccagaccccagaatggtagatccactgacagcttgcaccgtgtgcctggaaaagccacagacactcaacaccagcctgtgaaagcagccagaagggaggctgtaccctgcagagccgtaagtgcagagctgcccaagaccatggaaacgcacctcttgcatcagcatgatgtggatgtgagacatggagtcaaaggagatcattttggaactttaagatttgactgctctgctggatttcagacttgcatgggggatgtagccccttcattttggccaatttctcccatttagaatggctatatttacccaatgcctgtatccccattatatctaggaggtaactaacttgcttttgattttactggctcatagccagaagggacttgccttgtctcagatgagacttcggactgtggacttttgagttaatgcagaaatgagttaagactttgggggactgttaggaaggcatgattggttttgaaatgtgaggacatgagatttgggaggggccaagtgtggaatgatatggtttggctgtatccccatgcatatctcatgttgaattcccacatgttttggaagggacccagtgggaggtaattgaattgtgggggcaggttttcctgtgctgttcttgtgatagtgagtaagtctcatgagatctgatggttattataagggggtgtccctacacgagctctctctttttgcctcttgccatccatgtaagacgtgacttgcggctccttgcctttcaccatgactgtgaagcctcccagccatgtggaactgtaagtccaacaaacctctttcttttgaaattgctcagtctcgggtatgtctttatcagcagcatgaaaacggactaatacaggcagctttaggctaaacttaatttagcagtgtctgacacaaaatactagctaatcctcattttcaccatcatcataatcctttcatcttgcttgcatattgttatacccagcctagggtataacaaaagacttttgtaaaagcctagatgtgaaaacctagatgaaaaatatttcagtggcgtcctaaatgcttgacaagtagtcagtagtgttcttcaattatactgctttgtcttatattgatgaaattttcagatgtcaaaaagctgggacaagcagttattgcattacgttgcaaattttgtgtctaaaaagatcttagcaaaatggaatcctgggcaaaatctcaaaagaggaacttaaaatggctaattgggaagtcttgaatttggttaaaacaaaaaggcatcactgaactgcaagatttataacaaatatttagagattttacttttaatgtaatatgaattaaatgtgaattatgactgttaaaaacgtgaatgtgatattagattatgttaaaattatcatagtgactaaaatgaggaagctgatatttctactttctccacgtaagtctcaatgcactgagaaaaatgtgttccatgcaaaaatgtaacttgatttttgggcacttattggggaattgtagcagaagtaagcaatggtcagaaaaaaagagccttatgagccatcctaaggggatggagtttatttcagacacagtaagaatccattgataagatttaaaaagaggagtaatgggatcacagctgtcttttaacatgtgaatgttgaatgggacttggggcagggagaccagtcagaaggcttttgtgaagcccatggttggagggagggcagaaaacaagatagacacatgaagagatattcaggaggtgcaattgaccggactggataattggttggttgaggtggtgagggaggaagaagtgggaaaagcctatgatgactcccaggtttctggactgtatttgatactgggaatgtaagaaggaaaactgtcttgtgggatgtttggatgattatatgcatcagaaagtgaagcataggcaggggaactaccaatttcttttgatgttaaggaagaaaagaagctgtgtttggcttgatagataaagtccatggccaatttcttctgtgaaattcttgagtatataatcagaccattaatggaagagaatgtgaaattgctgagttaaccgtaggagggactttctaacatatactcattactgcttcaacacagctgaccttatccatgttgcagcctaatttaaattataatgcttattcttctgtgcactccaaaattctgactatagttttccttgttactactaacttgctataaatgcagatttgtacttttagtattgaaagtatacttttggctgaaaaaagggagtctgagtcaacttaactatgtatacatatatatatatttctaactatgttatagacaagcccagggtaaaacaagcaatatggaccataaatgtatgaatttatttttatcattgtttttgttattttggtatttttttctagactttgttacatgcatatttttctagactagtactcagtctgtacatacatttatggatcattaatttttttccttttgtttttagttgacataataattgtacatatttaactgagtacagagtgatatttggatacatgtatacaatgtataatgatcaagttagggtaattagggcattcatcaccccaaacatttatcatttttttgttgagaacattcataatcctctcttactgcttttaaacatatacaagaaatttttgttaactatattcaccctatagtgctatggaacactagaacttagtcctcctatctagctataattttggaaccacttatttttaattaatatgataagaattttccacattgctttgaagccttcatgcttctaatatttgtattttgttccaacattacattaactacagtaaaatttacttacaactgttagacattttggttgcatccaaatttttgctgtattgtgcagccctagaaataagatcttcatatggaaactttccttcactcactccaatactttgaattagtagatgagagttccaaaaggggagttactaagtcaaagtgttggagaaaaattatggaacttgatattataaaatattattcaacaaattaaagcctgggtggtcttgactccttgctcatggtcaacgtgagaagttgtatttctacttgggctttttagttcaacaatatatacgacatttaagcttaatggagaggcaaaagaaaggaaggcaaattaggaataaaatgaccacttttatcttaaacgtttttctcaagatttgtcatctcttgattttgataggtcccttcttactttcccctcctcccccattggctaatgacaagatctggtggcaacatttcttataagttttctcattcagataaattatcatagaaaggaattcaaaggatgggttgtttattttgtttagtgcttatgaaatgatatcctaaaagaggccattgcaaaaaccattatgttgacttccaaattggatcatcattttatcattcatttgaaatctcatttaccagtggcacccactgccagtttccataacaaatcaatttgtgtgtcataacactcctcgggcactcttcagtcacccatgaatgggttgagtacagctgtcatgagcaacccccaaatgttacctagaaatcaaatcttcctctcccccaaatctctctgatatagctacttcctcactggctcaacataggtacaaaaatgagaccatttgtagtctcggtcaggaaatataaaataaattaccaaggaaggtggtgaaatgaaaccagccaaacccctctcttcatcaaggacatgggagatgagtttacttttgattatgaggatcttatgtaataattatggatatatgacaggcatgagatcctaaaagtattactgaagcaagggtgatctctctggcttggaaagtttctcaacctcagcacttttgacattttgggctggataatttttggtagtagaggctgacattgtaggatatttagctgcatccctggcctttacccactagatgcaggtaacacccctgtagttatgacaaccaaaaaatatatctagacattgccagttgtccccttgtagatcaaaatcacccattattgagaaccattgcttagttacaaaggtttagtttctcaggttcactctttgagtcttggtttccttagctgaaaaatcaaaagaaagacttggttatctaagttaccctacaacattaatggtatttgaacatgccagggtcagggaaatagatttactggtctatataatctttaaagccctagcctttgtaattcctgaagtttaaaagttatttacactgttggtggggctataaacacaatgggagttcaaccattgtggaagtcggtgtggtgattcctcagggatctagaactagaaatagcatttgacccagccatcccattactgcgtatatacccaaaggttataaatcatgctgctataaagacacatgcacacgtatgtttattgaggcactattcacaatagcaaagacttggaaccaagccaaatgtccaacaatgatagactggattaagaaaatgtggcacatatacaccatggaatactatgcagccatgaaaaaggatgagttcatgtcctttgtagggacatggatgaagctggaaactatcattctcagcaaactatcgcaaggacaaaaaaccaaacaccacatgttctcactcataggtgggaattgaacaatgagaacacatggacacaggaaggggaacatcacacaccggagactgttgtggggttgggggaggggggagggatagcattagtagatatacctaatgctaaatgacgagttaatgggtgcagcacaccaacatggcacatgtatacataagtaacaaacctgcacattgtgcacacataccctaaaacttaaagtataataacaataaaaaaaagttataatattttttgaaattttttttttaaaaaacaccatggtattattagttggggaatgtaaatatgattagctattattttatctaagaggaaaagtatttttagagatgagaattggaatttaaaaaaaaaaattcaacttttatgttagagtcagggagtacatgtgcaggattgttacttgagtatattgagtgatgctgaagtttggggtacaattcctcctgccaccaaggtactggtacctaaaattagcaggtatatacctacttagcatactacctcatattaagtttctcaacccttgccccctccctacccctctctccagtgtctattattgccatatttttatctatatgtacccaatgtttagttcccacttataagtgagaacatgcaatatttgattttctgttcctgtgttaatttgcttaagattgtggcctccagttgcatccatgttgctacagaggacatgatttcatcttttatggctgtgtggtattcaatggtgtatatatgtacatttcctttatccagtccactgctgatgggcgcttaagttgattccatatcttttctattgtgaatcgtgctacagtgaatgtgcaactgcatgtgtcttttagactgatcattttagaaggatttattttcttttgagtatgtacccagtaatggaattgctgggtcacacagtagttctgttctaagttctttgagaaatctccaaactgctttccctagtggctgaactaatttacattcccaccaacagtgtataagcattcccatttctccacagcctcatcagcatctgttgtttttgacatttaaaattatagttattctgactggtgtgagaaggtatttcattatggttttgatttgcatttctctgattattagtgatgtggaacgttttttcatgtttcttggccacttgtatgtcttcttttgagaagtgtctgttaatgtcttttacccatttttaatggggttatttttttgttgcttgttagattaagttccttgtaaattctggatattagacctttgttggatgcatagtttgcaaatactttttgccattccctaggttgtctgttgactcttttgatagtttcttttgctgtgcagaagctcttcagtttaattaggtcccatttgtcagtttttgtttttgttgcaattgcttttgaggacttggtcataaattctttcccaaggtcaatgtccagaatgatgtttcctagattatattctagtattcttttagtttaaggtgttacatttaaatcttttaatccgtcttgagttaatttttgcatatgaggaaaggtatgggtctagtttcatttttctgtatgtggcgatccaggtagcccagcaccatttattgaaaagggagtactttccccattgcttgtttttgttgactttgttgaagatcagatggatgtatgtgtgtgactttattctcagttttctattctgttccattggtatttatctgtttgtaccagtaccatgctgttttggttactataaatttacagtacagtatgaagtctgataatgtgattcctctggctttgttcttcttgcttaggattgcttggctatttgagctctttcttggttccatatgaattttagaataggtttttttctagctctgtgaaaaatgatattggtagtttgatagaaatagcatagaatatgttgatttctttgggcagcagggtcattttaacaatattgattcttccaatccatgagtatggaatgttttcccatttgtttgtgtcatctgtgatttctttcagcagtgttttgtagttctccttatagagacctttgacttccttgattagatctattcctagttattttattttatttgtgtgactattgtaaatgggattgtgttcttgatttggctctcagcttgaatgttactgttgtatagaaatgctactgatttttatacattgactttgtatcctaaaactttactgaagttgcttatcaattccagaagttttggtggagtatttagggttttctagacatagaatcatgctgtctatgaagagagataatttgacttcttcttttcctttttggatgccttttatttctttctcttgcctgattgctctggctagtacttcctcagaactggaagttttatttgtgcaaatgccccagaattttgagattggaagcaggctggagtgtgatggagtcagaagatagaatgctggccaaagataagagtaaaaaaggagcgaaggtaaaatcagtagttttcaagtgtgcaaatacatacagaactccttttattgttttctttttatgtatttatttatttagagacagggtctcactgtctctgcccaggctggagtgcagtggtgtgataatagcttattataagcttgaactcccgagtggctggaaatacaggtgtgtgccacgatgcccagctattttttacttctatttttttatagagatatgtttcactatgtttcccaggctggtcttgaactcctgttctcaggcaatcctcctgcctcagcctcccaaagcactgggattaaaggtatgagccatcttacctgagtgagctatttggacaccactccttttaaacataaaataaacaaagggttagagaaaaaatggttcaaggagtccaggaactgttttctgttggaaggctctctctgtcatcacttggttatttaagttgcacagactggagactaggtgtgaaatccaggaattgcattcaaagtagattgaaaggaataattagcaaattcataacaatggtgagacaaggagctcagagttctagacagactgtgaggatgaagcaggaagaaaatgattaagaatacctagccatgctccacattccactgctttcactatgacaagggctttggtgatgttcagtgtctatttagacacacaggcatgctgcctgtcggcatgcctctgcaccgaatagaaccatgaattcagattcagcttcacaggcaagaacattctcatctgagagataatgctttctaaaactgagtcagaaaggagaagaggaaggaataataaatccccctctctcttgcttactctctcattctgtctctatctctttctctcctagcctgtaattctaagttatctagacaaggtactagggacacctgaaaacattcataactgaatgataacaagtaatgttatttaagtgtttgccattagtttacctgcttggagtggcttttataataaatcgtaatatttattagaacttactatgtgttcttatgtttgcatgtgttgtatttactatcaatgtaaacctatgaggtagttgctatttttatcatataccttttaggatgagaaaattagggcagagaatagtcgagtaacatgtccaaggtcacacagagcgtaatgatggcagaaaaccgaaattctgttaaaatatataaagtgttttattcggagccaatgtaagtgacagcagcccaggaaaacagtctcaagaggtcctgagaaagtgcacctaaagcagtcgggttacagtttggtttaatacatttcaggaagataagaattgcaggtaaaatcataaataaattcctgggaggtatacaatagtttggtctgaaaaggcaggccatctcgaagtgggagcttataagtcataggaaggtttaggagttatttatttggcacttggttgaaagagttaagctttgtttaaaaacttggggtcaatagaaaggaatgcttaagttaagggggggtctgttatttgtcatgtgatgccatgttagagtctggttgaaaagtaggccacaatatactgggtcaaaaaagacctgtttaatgagctttaagggtttgtgaggcatgactccccaggccccttagaaaggcatatgaggaagtaaaaaggtcagagtccattcctcagtacctttaaagagttcggactagaacccatcagatttgcaactgaggcttctctccttactgctaaattattctgcttccctgagcacactgcagtcatggtcttagcttactcccaccatgagcttatgagcaggcattgtttttatcttccttctacagatgaggaaactgaggcacggacaggatgaatactttatctaaaatcagaaatgaagtgaggaatcagggattcaaactaagttgggttgctgtctctttttcctctgacctctatgctccttggcctcctctcagagtgctgcaaggatatgcagtactaagcaattgtgcagcaaggcagatggaatccgagctcacctgtggcagcaccgtttcagtgtttggagaaagatgagattatatttggttgcttgggggttgttaaaaaggcttcatggaggggcttgtgttggctacggtttgggaaagtgggtctaattctataggaagcaagtgggaggagggcgttcgtggaagaaggagcagtataagcaaaggcataaaggccaagtggcactgggtttgctgcaggaaatgttcagttgtcattcagtttagagcagtgagggtgtgtaccttttagtatatattttctttaaaagtacagcaatttagagaaactcagaagacagaaaaaataagttttgattaaagtcagagtacccacatgcaaccgcagaaagtgaccaagacagggaagatgctgccatgagaacccacgtagtaatcacacaacagctgctgggctgtgttacatccaggggtgagaaccattaggatcaaaatcacaaagcaagtatcatatcacagtaggaagcttctagttcttccccaggctccaacgactcactatgaacccagacttgtcttttagaccccaacctgtctctgaaaaagtaactgctttgtatatgtatgcatgtacatggaaaggattactaataactaacatatctgctggcactattcttcattattctaaatataaacttatgtaaaggtataagtaatgcttatgtttaattgcacagttagaaaattacctgtgggtttaagaataaagttcatgaagagaattttaaaattctgcattataccttcgttaatacaatattatgatatttgaaatcaggatgagcctgggttggctactctacacagtgtgaataaatgtgaatgtgaataaagaagttatatttagagagccttgatcacctacaggtcttatcaaagaccctcttacacagttgatctcctccagttatcactgactgagaggattcagccagtagtaattctactgtcctaaacaacgagatatgcctccccactcctgcccctaccagaagaaaacttgcagcagtaaccattgaggactggcctgcctgctgtgtcctgcaagggagaagtagctgcagggagtgctgggatctgtgggatgtggcttttcaacatttttcataaggctgaagctcatatgcagatagaactcatttgcctgaagtcagacaccacggcaaccacaacctgatcaaatccaacccctggagtgtgtgtcagggcctctgtgatggagcacagcaggctcacctctgaagcagagtttgactccggaatcttctgtttgcagcatgactaagctttgtttttagtctccctcttggggaagaattaaacctgaccctatgaggaggcagcaagaactgaacagaaacccatatttattgatagtgactcttcctcagaggaaactgaagcaagtgtcttttgaattgtgttaagcctttattatttctttgatggcaaatacgtgttatcaatgtttattgagaagactgagaatatgctgatcataaaagatctaaagaatattaaacatttcccgttcatgtatctttcacaatttttattttttatgtgtatcttttcagaatcttcatatatatatatatgtatatatacactgtgtgcatggacacagaaggacaacaattttttttaaatatgaataacttacgatggttgatttgaagtctgtttttgggtatcattttagaacagaatgaagtactcattacttagtgccggatgagatgtcagagccccggcatcagaaagtgatcaactcacaggttggtaagaatttactgataactctataggtttgaaaaggaaatttttattattatagatagaaagtatactgcagaagagtgcagtggggcatctcagcaagagagggctgaccaccccatgaggaatttttgcttaggggtatttatggaacttaaagtgggaccttaagggtaatttggatcatgttagtcacatagcccatgataaatggttaaatttgtagacattttgtgccttaatggcagcaagggttgcacaataagattcgatatgcatgcattctggagatgtatagaaattctaattacttataaactttgggtagagaagcctggaaccagatgcctattttagatagaagggaagtccaattacttcaaattcctcagataaaaagttttgcctccggatggcttgcttgatgatcaccagttgatctttgctttcttcacttggatttgccaaatggtttgcattttgccccatttgttttataattttcctccttcccttccttcctcctcctttcctccctccctcccatcctatctattagtctacttctttatctaatctatcatttctctatctgtccacacatattttttgtaatcatctgagagtagtttggagacatcatgtccttttagtgtatatttctgtatgcatttcctaaaaacaaggttttagctatcttgtatagctacagtaaaatatattctctacatattctcttacatatgtaggggcaaagggaaaacttccttttgccctcagagggtttgttgaacaattaactcacaaaaggcagactcataagataaaaggaatccagtttattactgtgtgcacagggagaaccacagagtgattggcctccccagtgggctgcaaaagcttatttaccatcttgaggctacacacagaatgggagctcggacaatggccaaaaataggttgtattggtaaaacacattatgggagggagagaagaggagacttggtttgtgatatggtttatctgtgtccccacccaatctcaccttgaattatagttcccataatctccatgtgtcatggaagacaccctgtgggaggtaattgagtcatgggggtggttaccctcatgctgttttcatgagagtgagttctcacaagatctgatggttttatatgggggcttttccccacttcactcttgttcttctctgtcctgccactatgtgaagaaggacctgtttgcttctgcttcagccatgattgtaagtttcctgaggcctcctcagccatgctaaactgtgagtcaatgaaacttcttttctttataaattacccggtctctggtatgtctttattagcagtgtgagaacagactaatacagtttgcaaagggggtcttgttatgtagatgaaacctcacaggtagcaaccctcagagacaatagatagtaaatgtttccttgagacctttaaaggtgtcagactctcagttagtctttcttggatccagacaagggagaaggcctggcagtataaatgcaggttccctacagatgatgtaaatttctcccaggaaagacagctttgcagagctacttttatttgctggctctctgacagccatctcaaaatatgtcaaagaaatatattctggtgtaaaacacttttattttcctcacacactacaatgaaatgaccaaatgagaaaatatacattgatacagtatgattgtctaatccagagtttgtgttcaacttttctcagttgtcccaataatgtacgttatagctgtgttttccttgtcctgaatccagtctgagattccactttaagtttagttcgctctctagtttacttaatctagaatacttactcatgatttatctctcttaaccttgacgcttaaaggtgtccctcaatttgtgtgattgttttctcattgttagattcattttatgcatctttggtaagtgtacctctgaggagaaaaaatacaaactcagagctttttcctattctctttcccaacacaacaatcaatgcaatacttctgtgattacatgagtaagggtttttccacacacaccaaccactggacacctgctggatgtcctctaattcaattcagttctgatgctatctacctacagatagtgccagatgccacagatcaagggctcagtccccaggaatgcccttggcacttccagacaccagtcacaagttcaggcttccggaacttctgacccactggcttgaagttggggttcccatgattacctctttaaattcagttaacttgctaaattggctcacagaactcacagaaacacttacttgtgtttaccagtttattataaaagatattacaaagaatatagatgaagagatgcatagggtgaagtatggaggaagtggcacagagcttccatcccctctctaggtgggccaccttccaggaacctccagatgttcagctatctagaagctccccaaatcctatcctcttgggtttttatggaggcttcattacattggcacaattgattaaaccattagtcactgttgattagtttaacctttagcccctctcctctccctaaaagttaggagtggagttgaagatcccaaccccctaattgtatcttggtctttcgggtgaccagctgccatcctgaagctacctaggggctgccagtcaccagtcaataattaacatacaaaacatcactgtggagattctaaggattttagaagttatataccaggaaatgaggtcaaggaccaaatatatattttacaatatcacaataccacagaagtaatatagacccacctcaatgcatcatatcaggaggtacatagtgttggtcatcccaatattggtgatgttaaatttgatcacttggttaaagtgttgtctgccaggtttctcaactgtaaagttactgttttctcccattgtaatgagtcattttcctttggggaaatactctggggccacgtaaatgtcctatttcttatcaaactgttagcagcagcgaatccaacgggtctgcagcaaactcgattcttgcctcctcagaaaaaaacgaattcagccaaggggcataaggcagagggagagaccaaggcaagttttagagcaggagtgaaagtttatttaaaaagttttagagcaggaatgaaatgaagaaggccaagcaagagacttgagagatccaagtgtgctgtttggcccttaacttgttttgtacattggcatggttccagagtttccatttctcttcccttgatttttcccttggggtgcactgtgcgcatgcacagtggcctgccagcacttgggaggggccgtgtgtgcagtgtgtttactgaagttgtgccatgctcattagaagcgtttttcccttaccagttgagtgttcttagaggaaggtcgcataacagttaaactttgccattttgtctcttagtagacatgcttgagcccactcacccagcttctgagatcttatcagaatgctgctgatcaccagcttcacgtgttttctatcttgggaaactgcctttccctggtgtcagctgtaactaattattattttagagagacagtataacacatgccagaccaacacccaatggttgcttgacattcctggggtgcgggaccatctcctgccctgcttatatctgcctagctacctgctctaacaaaaccactggtttaacatccccttgggattttctaacttcatcgttacttcatatttactagttatcattctatgacaagggaaaacctctccctttatctctatcctctctcttgctctctctctgcagtacggattcatggattcatcaatgggttatagtctaccagtgtcattatttattttattgttcaagttgccccagtgtggtcacagggaggcccttcatgctgctgctttttccttttgacatgtccttattctgtgagcacttttttagttcttggcaccacaaaatgtttcttactaaccttgtactttctctgtccaacttgtggaatcagctcttgtcccaaggaaccttagatttttttttttttttgagaaaagaacttagaaaccaagatctgtggatctggtgtgctccttgctactgatgtgtctcatcagacagacctaggagataggagatacagacagcagttatttaaccatgagagcatatggatatctccagcttaacactaaagagtatgttctaagttttctgtttttcatatttttaaatgtcttcttcaacagctgggaattgagaaacctggcatgagactcattatttttctgcatgattcagttaatagataaattgcatggactaattgttatatcaacttcgctggcatataatttatatacagtaaaattcacccactttacatgtactgtttgataagttttgtcaaagtatataccactgaaatcactaaccataatcaaaatacaaaatatttccaatattccaagaagttccctcctactactttgtagttaatccttcatctgtagctctagggaacgactaatcttttgttactgcagattatatttttcatttctagaatttcatataaatggaatcatacaatatgtgttcctgtttctgcttcttcttgatgtttttgagattctttatcttgtgtgacactgattgatttttttttttttaattttgaaacagagttttgctctgtcactcaggttggagtgcaacagtgcaatcatagctcactgcagcctagaactcctgggcttaagtaattttcttgccttggcctcctgagtagatgggatataggtgcactccatcacacatgtctggctattttttttattttaatagagatgaagtcttactatgttacccaggctggcctcaagtgatcctcccacctaggcctcccaaagttctaggattacaggagtgagccactgcgtctagccctgattgatttttaaaccaagcttgcatcccggggataaaacatatttgttcatgatttattatcttttcatatgttgctagagtcattttgcaaatattttgttaaagattagtgcatctttgattttgaggtctatttgtaattttctttttttggtaacatctttgtcaggttgtgctcacaaagtaatgttagtttcagaaaatgtaataaaaaatgttcttttcttctattttttattaagtaaactgaagaatattgctataattcatctctgaaatatttactagaattcaccagtgaagctgtctaacctggagttttctttgtgggaatgctttttataatgatataaggctattggtcactcttcagtgcctttaaatatctttgttttgttctgttttccaaatttatttcaatgttaaaatttgtaatttgagagcatgttagtatgctacatgatattccttcactaccagaatagtacaaagtaaaatctattttttaaaatctcaatcatacattggaacatagttttacatcagcaaatacacctgaatactgcagagtatttcattttatacacacatgactatttatctgatttcactacttgtatactcactctcgttttctttaaacccactctattgaggcctttatgcctacttgaataacattactgttgccaacctcactaattgtctccactttgctaaatgagttggtatgtctttcgtccttgtttcacttgatccatcagcagcatttgactaagttggtcactttcttctttcctcacttggctttcaggacaccaccttttcttgagtttccctgacctctctggctgctattgtttgatgtcatttgctggttccatttcttgtccctgaacttttaatgttgaaatgccgtgaagctctgttcttggtcatcttctcctctctctataaccttaatcccttggtaatctcaaccagtctcataacttaaagtgtcacctctatcttgttaattccaaatttatatctccagcttggatctttttttctaaccccagacctaaaagtctaacagacatctttaactcatcatgttccacaccaaatgcttcaaaacttgctcctctcacctgcttataaattctccaaaacctactccttaaccttttaaaagttcagttgctgtcagttctgtctttctggttattcagttcagaatccttggcttcaactatgaatttcttgctctcttatattgatcaaaattcaaattctcttgtctttacatttctagtaaatcaaaaatcttaccacttttcaccatgtcattatattatcaactattatctcctctcaccctctcctgtctctctcattcctttctgagtctgagggaccatcacctctttcttggactataatcacctgacatgttcttctttcccactgcacagataaaaccaatttactgagatagtagtattgcagtagaaaaagtttaattaatgcagggctagcggagtgatagatatgagttttttactcaaatcagcctccccaagaactcagaggctaaggtttttatggataatttgatgggcagggggcaagggaatgggcactgctgattggttggagatgaattcatagagtctggaaaatgatcctagtgcactgagtcggtctctgggtgggagccacagaatgagttagctatgaatcatgcatccctgtggagttagttagtccccagaaagccaaagtctgaaaagcatctcaaaagaccaatcttagggggttgggtgtggtggctcacacttgtaaatccagcactctgggaagctgatgcaggagaattgcttgagcctaggagtttgagaccagcctggacaacacaggaagactccatctctacacacatacacacaaaagaaaaaattagctggacatgttggcgtgtgcctgtagtcccagctactcaggaggtcgaggtgggaggattgcatgagccctccctaatgatcatttattgcccttcaacaaaagtcctcttcgccaccccctcccatatcctcttttgctaggatccaagtccccattctttctgtaaccttaagatgatatatgaacttctgttcctcactgggggttggatctccattcagaaggctcttatgtatatataggttaaataactttgtgtgccttttctcctattaatcttctttctgagaactgatttttcagcagtccttcagagggcccttgggccccacacctaagcgatcttcttccagtacatctcctcattcactgctccagacactgtggttttctgcaattcctggaaaacacctggtggacttctctctctttttttttccccagagatatacttggctaacaactatattcaagtcatcattcaactttcatccatcctcctaatgtagcctaccgtgactgtcttgtcaaaaaccataaatatcttaccttcaccttcagagtttctaaatcctaccttgactgttctgtcaaaaactataaatatctcatcttcaccttcagagtttctgaatctatttaccttgctttccttcttctttttcccctattactcatcaacttctaatatcataaaatttatgtactatatttattatttattgcctgtactcctattaacatttagtcttcaagagcagggatatttatctgtttggctcactagtattgtgtacctaaaatatggaccaacatgtgacagatatttaataaattcacatggaataaattagacaggttgttctcattttccacagcaagatggatttatccatcagtccatttgtttctttgtccatatatccatgatagattgatctattgatctgtctatctaatctacctatatccatccatccatccatccatccatccatccatccatccatctctcttatctagctagctagccagctatccatctatttacctactattttctgtctatctgtttttgagcatttactctttatttactctgtcagaaatagtgttaaaagctttggaaaaagtaaatatacagtgatgtgctagagcttcttacgccagcttataggaactgatggttcaatattcagaaattttacgagctggcttttaaaatagtggtagcttgaaattggccatggtatgggtatttataccagagaaattggaaaattctgcaaatcagggcttttcctgccctttcccttcatcacccctaaccccagtttaccagtgtaccactagaagtataagacatctcttgccataaagcagttaaactcctaagcatatagctcctaaatacagtacgtaatagaactcaagaggatagttaagatggacttgcagtattcatgtcttgtggaaataaatgaagaatattcaaatgagaatagacagagcctacttactcagagcttgctttatcaagggagtcagctactatcacttgtgtttggcagagatgcagaagcagttaggtatttggaaagctttataagtgaaaaaaaggggaaaacttcaggtgatctaattggagattgttggcaaggggaaactggatagatagaagtggggcaacttatgtgattggtttggggaggattttggctttctctagtctgttctgaaacagataaaagagagggaacaaagataagaaagtttgccattgttgatagtcctgatcatcctgagctgactgatttggaggttgtggtatagctttctggacttcctatgtgggtcagagttctatcatcatattttgtctggctgttgtctgtaaatttggtctctttggtccttggttttgtcattttcttgcttatgaggggtgtttaacccattcagagaaggccatggtttcagatattcactgctagaggattgtcaccatagtcaactgtattatgaaatactgactttttagttatatcatcatggtaatcatataataagggagcagctgtgaagaagcatttaaaactctgagtagagtgcaatggaccatagtcttgacactatgactaaaatgacaattaatagttcacgtaagatgctttggacccaagaacgccaattgccaagacaacaaattccagaggctatggagattgaccttagtgatctaagtagctttttccttaatgcaaaatatagccagttctactttgcctgtttgatccaagtgcaaaatcaatattaaaaatgacatagaagccaccacgactagcccaaaagggatgtagagcaatgcaattgtccatcactattcttgtcaacaagtgacaccattttgtattccatctagggcagaagtagtgtccttaatgacttctgccagagttagggatcactcttttagagcttttacttctgtatgtatgcttcccactgttgggaacactgctgtgactgtctgcacaagcaatgggtcaatttaaaacatggctgcacctatactaaggatattacattgagatgacttactgtagatatgttaatgatatttaaatatagaaatgcaacttagattttgttgttctgtagacagtgaaattagggtcaactgttgaattgtcaatgtaaggatgaatttgatattaacaagaaatctgaaaatggagcagactgacctgagaaagcagtgggctactgaatgttttccagagtgattagccatttctcaagtgtaatgggagagtgtataatattccagctttgagggtgaggttgaaatagattattaactttaatgtctctttcaatgctaagagtctatgtctcagaatgattcttgtgagacgttgataatcctgtcgggagaatagtgattagtttcacaccgagctgactttattttacctagttttacttagttttttaaaagtttactaagtttttaagccagagttacaaaagttacaaagggacacttactagtattatgttgttttacctgccatgagaatattctatagtcatatgtttttcccctaaaaatttgttgtattttctctttaaagactgtgtgaatcatgtaactgaagatgtttccattttttttttagctgccataaagcccagggacaaatttgccattgaacatgttaaccatgcagggtcaaattgtctctatatttatgctttttcttcctggtctcaatctcttattttaaatgacattgtctctggctttatttttatgttttaaatttacttatgttatgcattctttcaagtacctcaaatcctttgggaagtgcaatgggaagtggatgaatggatcgataagtgaatgcatatataatggcatggcaaattggtgtttctttgggtaagtgcctataagcggtgataatatcatgttccacaatggcccagtaagctatcaattcctatccttgccagtaattttcattcttacccaatatccaaattcttattccccgattcctcagatggattcccatttggataatcatcagccccaattctatgctcattctgaacagttgtggtaaacactatttttttgcttgagatccaattggttaataacaaattgggtgacaatatcctacaccttttttacatatcataattagggctcagtaggtgcttgatgtatagaagaatgtgcttctaataataaaaacccccatattgaaaacaaaacttattaaataccccttgaattatatacagcctacttaaattggcagtacatttagtcccaaaattatggtacacttgatttgccatcttagatttaattttgaattaatttttgaatagtaaaaagtaattgcttctttccagttattactgatctgagcatgtatagaatgtgcccagttctgggcaacatccttggagaaggatgtcagctaactgaaataggttcggaggaagttaacacatttctgaggacttttgaaagtatgttgcctgtcactgctggagctatgaatgcttagtctggaaagtgattacattgacatggttatttctttcaaatattagacttgagtttctccactgtgcactaaaccttgtgcacacatggaatcttccagaaacacaaatattatcagacaggtggtacatgttcatggtaccaaaataccactacatcaagtgcccaaaatatcttaaaggtcttgcaaaaggactatacgggatgtggttttctgataactgccatgtggcaacctacctgtcaagccacctctgtgtatacctcctagactgtgttctaggaatagtcatcccctggcagtatgggatgggtttactctgtcacccaaacaatctgctttttgttttcctacagaaggcaccttaggtggattgattaggagagatccctgtagcctggaaactggttcctaggaaaggaagctgaatcagaaagaatctgggtggggagccctgcttttcctacccttaccctcacctccaaaacaattcccgaatctgcttttatggctaagcagtatcaaaatcagagaatataaaagagagaaaaatgggctgacttgttctttcagtggcacagttccaaagcattttaaatcttaaacattctaaacactactgcagtatacctgggagagctgatactaatttaatcaaggcagaggaggaagtctgtaacagtattccctgtaagctctgacattttccaagggtccagagcctgctgggctccatttgtaatttcttcaaacttctctttttgcaaaaccctcctggatattaaaataccctaggattggtggtaactgcaaccattccatttcatcttatttgcattaacttccagccagacccttatggagggaacagttgacagagttgtttgttgtcaaggaaatggtgggaataatagggaaaaagtatgctctctggtagtcattttgtcaaaagaaagttacatagatttaattaataatgagaagattcttctgtagacttagctagcactcagttaagggttatcaaatcctcagcctggaattttgaaagtgactgggcaatacattatttgactttgtttttaatatatttacctttccaagtatgtgttgcttatactaataatacaattattttgcatttgttggaaatattctgaattagaattgaggtcttgaaaataggtagtgaatttcacaaaaatgtggctttaaagctaagctttgatcaagcttctgttgggtgcaagtgggttaattaattcaatgaattaataaatgaataaacagataaacaaatgcttttttaaaaagatacgagtaaggttctttctgtttctgaaaagacagataagcttctgcccagccaattaagacttaagaagaaggcacaagtggtgagctatggaggacaaagggaaagaaaaggagacgtttttaactggtgttttaggcagaatcctcagtaatgacacattccatttaatagcagttttaatttctccaatcccttctatattcaccatgttattttattttgaggtggtttaggcaaattatcatcattactccatccaatagataaagaaatggagacagacaggataaatatgtgcctaaagtcacatagctgcttaataaattgtttgaggccagatcccagggctcttggcttaaccatatactctttccactagattacctggacaagcaaaatttatgaattatctccattaaatataagccatcagtagttactgtatcttaattgttctctccctcccttccttcttctttcccttctctttctttcttttctttttcctcttccctttcttcttccctctcttctttactctccatttttctttctttaaaatatcacgacattggcaagcattagtaatccctttgccagagaaaatctaatcctcactaacaatgagtctgagttttagattcttaattcatcacatgttgtatggtgggagtggggttggtataaaaatttcctccttcatagaattattctgaggattagatttgattattacgtgaagtgctcagcacaacttctagtacattgagagattaactactcaataaatggtagctgttgatgctgtgatgttgtatgctcaccaagtaacaatgaaattgaaattgataaaaagaaattcatcctcatttcaaagagagggaaatagagtcacaaaatatacagccttgatttgagatgaaacccaggtatgctgtcagttagttagggctatttctgggcaaattccagtcaagtttaatatagtccttgcatacgaaaagatttgtagtgggttgaaaaatacccagctagtgaggaatacatgaatgatctagttaacaataggattgtgaaatcataattatgatttagtggaatgggttgtttctattttataaacaagatgggaaattatttaaagatcaggacttaactagggaaacgtctttggaatatgaaaatgagaattctgaagttaaaagcattagcagaaaaaaataaggcttggagggaagagagacttcagctatggctttgatctcttgaagtcgatatcaaaagccttccttctaagtggaatgctaggatctgtgttcctccagcagtggaccagtggaggtctcattcataatagtgacacctcttaaatcaggcctctcaccctggctgctgacatgttgttgggtgtagacttgacttgcaattgtagatgaagccccatgccaaatggttcaattacagttcagaagaaagcaatgataggataaaggcagtattggtccacatgcattctgaatgtgggcaatttctggcatctctcagccagaggaggtggtttccttttattctcagaactcaagatttcttacccctcaacatttagccatcccccaccatcatccatttctccacattactttgtagaccttctggactgtatctttccaaattcagatttccttggttacaacacaaaccttcccctccaaaggacccagtatctgatgcatgttttaacatctcacttttatgtgttaattatgtggttgtttaggaaatagttggaaactgacttaagaataaggatataaaatccatttaagattcctcttaatattgttgttccccacacccccgccccctaccatctcaagcatctgggcacttggctaaaggttagtgcaatgacacaggcttcctgtcccccttagccccctattttctaatatccatcccttttactttctagatgggcattctgcctgaaatgggataaagctggcacactacctaccagaaaagaaatctttgttttcagacagaagtattgaatcgaatctctcagaggggagcctgaccccttccctctcttcccgccccctccatctggaagagaagagaaacagtgaaattcaaaagttgccaaagtttaattacttctactgaaagtgccaaaaaaaatgtgaaagcttatcctttagtggaaggaacccagagggccctgtggacatttgcagcagtctgtttgccatttgtttttgttgttgttgttgttgtttttgtttttctactatagcccctgagtagcaaatttccactttcttttccaagacgaaggaggacagattgtccctcagagatttcaaaagggtgtttcagattctgccactagagacagaactattgagccatccccaaatatttctgctttaagattcacacaatgtgaaatttcaggcaagcattttcttacaccattagctcatcatatcgaccatccacctatacaaattgtgttaaaattacatccatttctaacaaactcatcggggccacctcagcagatattaaaatagatgtttttcttaggggagcaacaaaaactcaacaaacaagcaaagaaataaaaattacaaagttgtaatatgaaattgtaggcaattagatgataattaacattctcattaaacaacagttatcaattacctaccatatgtcagatctacacacttttatttgttttattataattatttatcatgacaaccctgtgaaagaaggtaatattttcatttaataggttcaaagaaagctaaattttcatcgaggttatgggacttggccaaagttacccatctaatcatgaacagagctaaaatttcaatccatgttttctgatcccgaggccaggcaatatttactcctcagttaactctcaattacacagtggctgaactagcttgtggatcaccacacatttatctgcctcttcttttcctgtgctatattttctatgtgccttaccttttaataatacctgtacagttgggttgacatataccaacctcaattaacaggtaacaaaattttcttttctacttcttagtagttggataggcaggtgaatgagcccaataattaaaattatatataaattattatgaattgcaatgattgctattttcacatttctttttctttctttttttttcttttctttctttttttttttttttgagatggagttttgctcttgttgcccaggttagagtacaattatgtgatctcggctcactgcaacctccgcctcctgggttcaaacaattctcctgcctcagcctcctgagtagctgggattacaggcatgcgccaccacgcccggctaattttgtatttttagtagagacggggtttctccatgttggtcaggctggtctcgaactcccaacctcaggtgatctgcctgcctcagcctcccaaagtgctgggattacaggcgtgagccaccgcgctcagctcacctttctttcatatgtggtagtcaaaactggtgacatgaagaatattttttttaaaaagaacaaattttcaagttgaagatagtaaacaacattgtttgaaagaaatacagctaacattccttcagcttttatcaacaagcctgttcttaaaggaatatccttttcattacaaatgagacatggtaggttttctgtcctgttggtgactttttaaataaaaaaaaaaagaatcttacatctttaagttttctgtgaaatcagcatgctttgctttttgatttctgatgtctctttcttctcaatctagttctttgtggatttattgcacaaatctgtgcagcagctaaaaactgtcctttgatacaatgcaggcagtaagcattaacttctacattgagggaaattggtatggaggatgatggtgcaactggggattggaagccagttgggctgtgtatttcaagctctttttactttctaaatctctgatgtacctggttcattcttaacaacacatggaagacagaaattgccctcagaggttaagacattgacgttgattttgctagtccaatctccagttgaagccaggttttgatttttcagaatatcgcaaaaagttcatattttactgacgtggactcaggctgtatgtgagtgtgtgtgtgtgtatgtgtgtgtgcatgtgtgtatgttgtgtggtttgggctgggctagaggaggcagcattggttgaaagagtaaagaagccaggcatggtggctcacatctgtaatcccagcactttgggaggccaaggaaggtggatcgcctgaggtcaggagttcaagaccagcctggtcaacatggtaaaaccctgtctctactaaaaatacaaaaattagcctggcgtggtggcaggcacctgtaatcccagctactagagaggctgaggcaggagaatcgcttaaacccagaaggcagaggttgcagtgagccaagatggtgccactgcactccagcatgggtgacagagcaagactccatctcaaaaaaaaaaaaaaaaagagtaaagaagaaaggagtctgagtgacaaagtgttctagttattgaattaatcggcttctattctacagactaaggtctgagatttggctactgtggttctgtttaagcaaaatggcatatttgggggagtgaaaacattccttccacaatctccttagaaacagagctccctggtaaatttggcaaggacactcaacagtatagagttttctgcgtgagattagttttagtaaaataatcagtaaagacagagagatggccaaaattatcttcgtctaagttacactccagggaagggatataaagacgctgtttattggtatctgacattattggacacctgataattgttgaacaactcaccattaaatagaatttaatctgcttttgttctgaaatcttgttaagaataaagtgagagtaaaatggtgtttagagacaagacacagaaccagaccctactcctcctctcttgaactctgtgaaattagcatgctttgattaaagataattaacaggcttttttgggagcaggtttagatttatagaaaaattgaacagaaagtagagggttctcatatatcccctttctctcctcccagcttcccctattattaacattttgcataagtgtcgtacatttgtaacaatggataagccaatatctgtattactaaccaaagtccatagtttacattaggatcattctttgtgttgttcattccaatggttttgacaaatgtataattacatgtatcctatgttgtagtgtcatatagagtcgttttactgccttaaagatcccctgtgcttcccctactcatccttccttctttcccttggtggaaattactgaattttaaaaactctctccatagttttgccatttccagaatgtcatatagttggaatgatacagtatgaagccttttcagattggcttctttcacttagcaatatatatttaaagttcctccatttctttttatggcttgatagctgacttgtttttcacactacacattccattatctggaggtaccacagtgtatgtatccattcacttagtgaaggacactttgattgcttccaagctttagctatcatgaatcaggtgcatctggggattggaagccaattggggtttctatttcaagccctttttactttccaaatctttgatgtgcttggttcattctcttgaatgaacctcctcttgaatgaatgctttaaacatttgtgagcaggtttttgtgtggacatacaatttcaactcatttgggtaaatggcaaggaatgggattactgtatcctatggtaagagtatgtttgattttgtaggaaaccaccaaactgtctttcaaagtggctgtggcattttgcattcccagcagcaatgagtgagagttccctctacgccatatccttaccagcatttggtgttttatattttggccattttactgggtgtgtagtggtatctcactgttgcttgagttgtaattccctaatgacttactatgttgaacatctttttgtaagcctttttgacatgtatatatcttttttagtgaggtgcctgttcaggtcatttgcccttttaaaaattgggttattttcttattgttgagttttaagatgtgctttgcttttttgatttctgatgtctcaaggggaatgtgctatagaggaacaactgttatgcaaattttgtgtttctcaagctggggtaaggaaagtctaggcaggcagtgcatggacatattgtcaaaggtttatgaattattattttatttgagatgatatctataaaccataagagaaacatgtattgctaagctggaggaccactttgaaaccaagtcttatcttctttctgcgcctgcattttcattagtatttacaagtgctttaacaccaagtaatgacacaacagtgacatcatttgtttttaatgcagtatttttaaaaccagtattttataatcctgctagtatgtggatatattatctgagatccagaacagctttatccctttctcatcctgcagttcaggtgtttctggagagaaacaccagaaatatcactacaaggttttggtcacaaactacaataatctctactatgttagggcaagactttctttgccttggttagacacaggctcgagctagaaccaaagcagagaagagggactgctctttgtccttttccccaaattcactttccaatcttagatttttaaagtaggggaatgcaagagcaagcaagaatatttgcctaaacacaacgttcttttttctctgttgataagacactatgcagagaaatgtggctcaaactgaatagccttgcaaccttctcactgaaaagtaaaatgcttgggtcctgagaggcataaagtggtagaggcaaagcaaaggaggccttgaactgccttccctgagagaccactatatacgacatgatgctgagctgcaggattcaccagcagagacctggcaggtatccaggcaggatgacggcagcataccggagaactctgcccattgaaaagaacagctgctattcagtgtcagtcagttgctgcataccaaaatgtgggctcaagtcagatcttctgatttttcaagggaagctggaaatctgaatttaatgtaaaatctcctaattttcaaatgttggcaatgagtttggaccctgtgagcatcatgaaacatatctataaatgagatctggcctatcacagggcttccaagttggtgatttttgctccagttgggtttgcatcgctagtgacttgctgacaagaaactgcatcttggcaaacacaaggtggctatgtggaatatgacacgggaagcacactttgcataattttaaagtacgtgacttttttgcttccaaacatatttagctaaactgtgcgggttggctcttgtgaatgcatattacactccctttctacctgctgtctgatccaacccacacaaacccagacagagagatacatccttgaaggtgttactgcctgtatatggataaagattgaggaaaccagccttcctcttgaggagtactagatctcaggctctgcaaagtaggaagagatggaaagagaacacacacaagaaaatcagaaaggaggaggaattcagaccagaaatcctaggaagcagaagttgctaggttgctgagactcaaaggtcaccagccatcaaatgatgtttcagataccaaagctgagaatcacagctgagggcagagaagtctggtgcctgggctgatgcacacttcatttactgctttctatatcagtagctgtggtagggagtattggcacctgtggggtagggtatgtgtagttctaggagttaatttgtgttgacctattcttgggtttaataccgttttagtcgatccaggttatagaactcaatcataggacacattgcattgtctcccccaaacacctcattctcgtgaaaacttcttgttaaaaaatccatttattctaacaaataacttggcataacaaacagaggtcatgtgagaattgttacaatagccaggtgaacaatgcatgctttctcaaaaagttaggggggaaaaagatttgtaaacgacatactcttgtaggaaaaacaaagcaaagcaaaacaacccaggtactcataacaattcatccagatttccctcgactacttattaaatgccaaccatatgctggggttttgtgttctgtttaacagaccctatctcaaatttttatcttaactttaattgtgcccattttatggatgaggccatgcttctgtgaacacaccacttgtgcaagttcacagatcaaataagtagcagagctatgcatccaaaaagactacatgtcccccccatctccaccaatggaacatcaaacttttaatgtctcttaggggcaaaaacattgttttctattagggatttaatttgactaccggtttaaaaaggtgatctcctctttctgtagcataatacattcaatggaagatagtcatttcgtctcttttgacatgacagcactgtggttgtgatatatgtggatagttgaatgtcactaccaccatactgttgggttaatgccaaacctccaacacagcagactgagaaagagaaaaacttagtcaacccagtggttctttggtccacataatagtaaacaaaagtttaagattaagcaacatcaaatacttcaagaaaaattaaaatttttagcatgtgatgatggatttgaaatgcttacctggggcccttagttgtgaagagacactttcttggatgtgaatgtggaatgtactttgggcgacagctaaaaaagtcagcctggggctgctcactgttctgccccagggagaaacagataaacaaaggagttccctagactaactagataatacagtttagagtttaaaatgggaaacaaccaaatccaaattatttcccgcaaatctatggggaagaataaaaggaatgtttctgatttagactttgaatgcaaaaactctgcttcatactttgttgagacgttccaaggtaggtccaaaatcagtacttaacttcgcttccctaatcacatgttttgcttccctaatcacgtatttttttttccttctgtgtttcccaccactttcttgccttttgtctttcataaagtatttgtagaggtcgtgatattcacactgtcctgtgctctggatcagtggttctcaaagtctgctccctgaacttgcagcttcattgtcacctgggaaatgttaaaagtgaaaattctcagatccacttcagacctgctgaatcagaaactcaggagtgggatctgggaatctgtgtcttaacaagacctccagatgatcctgatgtgaggtcaagattgaaattgtgactaaactagactgcaaaattgaacaggacttgtatcttgtatctgctcttggtagcttgcaatttgataatgggcactgcattaaattattagtttatgataaactatatgatataggtatgctcagggtgtgtggatgaacaaagaaagagcaacaaaataaaaatcaatgttttagaggaacttctgtgacactttaaattcagcaactttttattgtctaaagagtgtcaccaatatatttgcatatttgcgatgtgcagccatcttaaattagcagacaccccaaccactggtgatccataacaccaaaccaggaggaaatcaaatttaattttgagaatttttcaatatagatgatgtgaaacatccctttaatgtttttgtctgcagagtcattcagtttttctggggcctagaatttgaactcaaccccaaatcaggagaaagacttagagggaggaatattcaccaatcccaggaagaaagagttaatgtcagatcctacaaggtgaattgcatcctgttgcaatttacaacaggatgtggaaatctttgctgatttattgcagccttttctgtcaaggtattttttcccccttggtaatctaatcagaaagacaacgtacatttctgtgggattttttaaagcatgatactcacaggcaacagaggccagagaagaggttcatattagaagaacaagcctatttgtaagatactgtgaaagcagcagctacatgaaaaaacctcagaggcggaagtttactgtaaactcagggtgagtcaacagaaccacaagactgccaagaaagttaatttgatcttaccctgcatgcacaagtggctggtatttaaaatgggggcaggctgtgagtgttctgctcagtagaggtcagaacacacctggagtattgccttttgttttgagcccagttcaaaggaatttaacaaataaaccccaaatttccaacccaaatcagactctagcttctctacttagtaattgtgagggaaagagagaaccatcaccctcagctggagataaaacctccatagtgctcttcactttttgggagattgtagggggaagaggaaggatgagaccctaagagatctgcctttgaccagcagcaggatgcatcacctccatgagtctttgaatatgcaaatagaagcccctgaagggtagcacaatatgccaccccaaaatatgctagccacttttgcctaaggataattttgagctaaaggcatattaacaaaaaataaaattctaagctcctgaataaacttaggctgaatgggccctgccttggccaaggggattccaaaaaaacctgaagaactagttcaggccatgatggggtcgggggaggggaaggatgggggtctgacatgcctcatcacaccctcctcccttcggagtttagacaacagtgaccggcattaaaacagagatcttaagactgacaaaacagactcattatagcaagaaaataccgaattccaacctgactctcgtacagcatcacaggacagcaggccctgaaggaaatgaaagtattttacacccaaatatatttctttgacgtattttgaaatggccctgcaaagctgtctcttgtggggaaaatttgcactcggtagagaaccttctttcttactaggtcttttccagagtgtctgacaccttttaagtttcaataagagaattttaccatccattctctctgaagccggctggcctgaaggctttatctacatgacaagaaccttggcttctgcaatatccctctccccttaactgaccttaactcaagctgatttcaattctttcgaccaattgacaatcaggaaatctttgactccacctatgatctggaagcttccctgcttcaagatgtcttgcctttccaggccaaaccaatgtataccttacatataatgattcatgtctttgtctgtaacttttgtctccctaaaatgtataaagccaagatgtaacacaatcactttgggcacatgttctcaggaccacctgaggctgtgttacaggccatggttcttaaccgtggcaaaataaatctctaaattgattaagacttgtctcagatactttttggtttacaggtaccttaaagaagaaaacaaattaaagcaggaatcggagcgagaggtttgttggttttggaacgtaagatcccaaaccattggagaactgcagcatggtgaaggcagtcgaggtcccatgaacttgtaggtgactttagctggatctaatggggcagtaggacaccggttggtgcgtggacagttagtgggtgagaagacagtgtctggcatgttcaaagctgcttagccagatgagtggcaggaggagctgtgggcatttagctcagacagagaaggcttgctgtgaagtacttaaaggctgccatgtgaaagagagattaggattattcagtgtgtttataagagctagaactaggaattgtaaagtaggaaattacctgagccagatttcagatcacagaaagtaagtcacgagtacttaccagctacctaaagaaggcatgacgtttcccagaaagagggcattttctattgagggatgaaaacaaatgttggttaaagcccaagctctgctactccaagtaggatcttcagaacagcatcatctccatcaccagggagcttgttagaaatgcagaatttcagaccccatcccagacctactgaattagaatatgtagcatagtaagattcttgagtgatctatatgcatgttaatgtttgagaagtcctgagtgaaaagaccaatctctagggatgttattcaaagtagttcaaataattaatggataggtggattcctttccatctcctaagggaggtggggtaatgtgctgctgcaaactttgtacggtaagggaagaaacttatcccgctgagttgttggttttaataaaaataaatcctaagaacagaagaatgtgcaacccagaactagttagctggctctggataatagaagattctatctgttttaactgtaagcatctattacactctgccaggcactgggaataaaacaaaatgaataatatatgcatcgagctctatgtattaaactgttatactctgcccctaatggttgaaatcatttactgaccctggggctcttgccttaatttctggatgaatttagctcatccttattgtcactttcttccagccctgctcttttcttaattcttgataatattgctgttcacatgaatacccaatacctggaatactccaccttgttctattgttttcttagtatttagcaccttcaagcacttttataaattattttcttatttagcatttgtgtggtctgcttttctttcactagaattacatgtttcattagtaagaagatttaggtatggtggtaccctgatggaatactgataaaacaggtttgaaatgagctttgatttgtagtgtttgccaatccctctggtgtaaatattcctgtcatggccagtttgaagctactgttactacatcactgaatgtgatgttaggaaaaatgtgcacaattgactcttgtgagctggcctgagcagcttccatcacacagttggtccctagaacagtgttatttagaacagtgtcaactccaagtaagtgctcaaaagatattttttcatttacttaatgaaggaatgaagtggaaaaaaccagattgtcatataatctactgatcgtaagaagaaagtgttgtgtagacaaagagaagagacaattaacagtaactttatggcctattggaggcttctttctgaaggtgacaaccaaactgggtgtggagttgaccaggcagtgaaggtagtttatagagaatgagcaaagttgttctaagatgagcaaagaaaactagaatggtgagagttcatggcagggcaatttggataaagtaattaggataccaaaaggatgggcctttagaaaaggttaggactagaatgtcaaatgtcttgagtgacacattaagcagcatgttgagggtgatggagagtcactgaagaaatctaaaaatgagagtaattctagcagatttgccttccagatgcctctgccagcaatgcgggagattaattctagcattggaagtagagtagagggccagggagactaaaaacagactattgactaaaaaccagcctaggaaaagatgtgatgagggactgtggtaaagactagagtggaggaatgggatatgggaacacatctgagagctcttcaggagtaggtttgatgcaggtggtgtccagtgggatctggggtaaggaggaagaaggtaagatgattatgagattatttgatggttactgtggctttaactaaaataggcaacacaaattgcaggaacagatgtagaggaaatgaaaaatattccttgtgctatgctgaacctgagaaggccacacgccatcccggtggagatggcacagtggagaaggcaataaaccttccatggactttgaggcaatctaatctgagtgtaacagagcactgaggctccggttcacctctggacagctggcatgggtgcaaagacattgattgacatgttaagaagattcaaaactactcaaagccacagagttagaaatgtgagttttatattgtggacagaggttaaaaaatagatttaaaagtcaacaacatatataaaagttctggaagcagatggaaactcagggaaagactgttgtaaaatgaaaaattaattaatagggatgacagtgttggggttatacatacattgatagggggcatcaatataagaaaagatgtcaacaggaaataaaaaaaaaatactcccacggaagtggaaggtaaaccacagaagaaaagagtttcaggaggttggggcagggagattaagctgattaggatagcaattgtcacaatacaataaaatgaagatgggccaggagtattggctcacccctgtaatcccagcgctttgggaggctgaggcaagtggatcacctgaagtcaggagtttgagaccagcctggccaacatggtgaaattccgtctctactaaaagtacagaaattagctgggcattgaggcaggcacctgtaatctcagctactcaggaggctgaggcaggagaatcgcttgaacccgggaggcagaggtagcaatgagccgagatagcaccactgcactccagcctgggtgacagagcaagactcctccacttcaaaaaaaaaaaaaaaaaaaaaaaaaaaaaaaaatgaagatggaaaacttgtcgttggattagattggtggtcattgtatgatgttactatagaggttggactgtacaaattgcagtgggcagggtgataaaatgggaaaggagaaaagaatgagcaagtagaggacactgtcttcaaaatgcctgatcaatgggtaaatatagaactagacacctcttgtctgattttgttattgatttaacttgctgttgaccctggcacagctttatcctatgcctacataatgttgagtcacttgatgtttctatagagtcatagatttggaaatattgttatacttggcttcactcagacaaaatatttggttgattaatgaattgttaccagtcacctgtcactttgtcacatttcagacatatacttcgcttgtccatctctacccctcaatttcctcctccttttgtaaattatacttcaataaagttgactcaaaaagaagaaaaggaaagaaactgaaagggctagtcctatgtctttagctcacagtaagtattgtgaaaagggacttttgctacttcatctatctcttctgcttcttctgtcaccaggagcgattgcttgctggtagggcaggatttgtgttgtaatcctttaccatcacaaacattatgatcccatttccagtttaaatgttatcttgcctcctttaaccttcactctctgctcacatgtaaaaatctattcctcaagtcccttcttagccttagcaaagtacctttggcctgacttcccctttgatctgtgatttctaattgcattctataaagggtcctgcttttacacaatttattgaccctttgacaggaatttggactagtgtcattcgacagaattgatgttttctgcaatctgacggctgtttggatttcagagtcgatagccaacaataatattcctgtgacctttcagagtcactgttttcttctgctgtaaggactagacacatgagattggaaagaactgcccaaactggctttcttccattcagtaggagaaatgatgcctctgactaaagtcagaatgatttacattaaaaatataaaactctctagtacagaattgagcatgaaattcctcctgtctactaatcaattgtatgtatgtaaatattctgtaatttatgatgagttctgacaattggagctacaagtggtattgtcaaattttcgttcaattggtaagaatatggtattgtcaaaactgtgatcataggtatattttttatttttaaattaaaaagctttttcatttcttgggctgtgacataagtatataatatactaggtagacagtataagattgctgtttcatagatcagaaatggttaataatggcaattctgtgtgattcaactttatgcgcacacacacacacacacacacacacacacacacagccagccagagcgagagagaaagagattttttcttaaaatgcaagtacttcataacagaagtttgatacgaaagtgttgatttgccatttcaaaaacaaaacatattattcctattgggtcaatgattatgcaatattagtggaataatattaattgaggacttcctatgggtaaaatatttaatcataacatttctataaggtagaaactgagcagggcttcccactatattatacttctgcctgagatttaacatttctcatgcatatcttggaaactgaagtcttgatggaatattcattagagggggctaattataaccaacaaacagaaatactctttaattccaaactatgcaggatgctactaagtttgatatcagagaagataatttaaataaagaaacaggaggcaaaaaccatgtctgcctagtcttgcctttaaacaactgcaattttgtttaagaattactaacttcttggtgctatggcaacttatttgcaagccattaggatgaggctaagatgatttaaagacctctccccactttagatggggctcattacattcctgatgacaccagcaggtctattaaggtgataaagcaaacggagctaaaatatctttctccaggtttcctcccagggccaccctcatcagactcatttggggcttttattaaaaatatagatctctgggctctagctccagacctactgaatgagaatccttagggatgaggcctagggaatctgcatttaattagcttttccaaatgcctggaattttgttagtgctatgtaaatgaatatttatgtcacatgtatagtgctaataattcttaggcatctcaaatttgagaactgctaaaccagagagtgtggtaagacatgcagatttatttgatcctagactcccatccttactgcaccagaaaatgggaaagtggatcatagactgatctactgaaatctctggtaaagacatggagtttttctaagatgcccgttttgccctcctcattacagaccctccgtggatcctgctgtctcaggcacatccctattttgctggaccctctggcgctaactccttctcttgggatacaggttctgctcctactttgtagttgcttgtcctctcagaatgcagaaaaaatgtaggcagtaactatcattagagatcatttaggttctaaaagatttttaaaaatgactttcagttcagaaaatttcgtaggcccttctgtaatgaggaccctcaggggtctgtggccagagtgctgaggttcaaacctctttattcactcattcatttaaaagctaatatatatatatcaagtgcctgctatgaatgaggcaccatactaggcccgagagatacttattatcaattataacgtcaagcatataataagtactcaatatatcttttttaatagacgtgacactgaacctcctacaatgcctttaatttaccagtgacccatctacacttggtgtgtggcctaaggtcaaagatcacttactaatgtggaagagccttttaagatctacccctgacttccacttcttccctttctccatgcttctttctctcttttaatgtcctaaaacaaaatgaaaagttcagtgggaaatgataaagttcagatttcattagcttttgatgtcacttttccttggggagaaaaatcacatttttgggtgacctttttagttaattcacagctgggagaaaatcacacttagtgtctttcctgttaagaggtaattagacgctgctggtcagtgcagtcctatgagatgggctgtgcggtgggggtgaacagaagcaaaatattgcactcatccttttggcctctgattcccagcgcctgggccacagtggccattaaaggaacgagatcagtaagtgacaactcagactgtgacaagcagtgaaatagaggtacaatacccggggcagagagggctcactgcagacctgggatttagggaaggcctcagaagaaggaacatttgaattgaaccttaaataatatatgctaagcttcaaaggaactgaaatgtacatgcacacgcagagagagtgggcaaacttgatttctacaagagtctactcctggatattcctataacagagctaagtcacactgctgctatcaggacccagtctttcctgctgatgggctttccagactcactagtgttagccacataactgttcttccagaaatgctgggtgaagacggatctcagagtgtttttattaaaacactgtggtctccagtaatatcacttatttgtgagtttccccaggtggaaagggtccacaaaattggtggtgtcaggtacgattcccataagtagaagatgaaaagaaagatccatgaggtcacatccagtctgtctctggaggatcagggcaggaggattccgggatgtgtttattttctagcactctgtccacctcagacttacatgtttacatttatatagcacctttcctcaaaggaaatgacttcactcgtggaaaagcgaaaggtcatttgaaatttgagttacatagagaagcaataaacttcacgctgtcaggaggttgcgctgagactttgtgaatgatcctttgtggattgcaccccatcactcccacttacctgcttgcctgtgtgagatttttgtatgctattccacacttgtctgcatgctgacctctcatctcccagacagctcctttggcttccccagtgaccttaattatcacctcatcaagaatacatatttagtgcttttaatctgtccccagaaatcaatctatcctctgcatgcattacttttgtttaacccttttatcaatttcctaccttgccctgctgcatttctactttctggtttgaagtgactcagaaataatctatcttctcattagagcctcgtaaaaagggactttgcaacctgccagctatgtgatttttccacctctgaaagtgaactttgaaatgatattagctcctttttttttttctatagcattgcatgactggtctaaatccgacttgccgcctgcatgtctctcttcacggctctttttcaagtcgcctgcgtgctttgaatatttctcttcaaagggaggggctgctctttccctccagttaaatctctctattattttctactctcatagctattgctgctaagttcctctgcatctctcttctcctcgctttcctggaatttgcaaccctttctatttggagtcagctaagagtttcttttgtgtgaggtcttctttgcactttggccatgaatataagtgatactatgaccaaaggtaacaactgtgcttgcagatttcatttggttatagggctgtgcttttacatcttccttaattgttataatatgttgatcaaggatgactcctctgctatagaattcagggaagtgaactgggatagtgaaatgagtacaggctttggattcaacagatcctggttcaagtccttgctctgccgttaccagcccaagattttgtgttagtaaaataaagatactgtaacaaattattataaacaggatggcttgaaagaaatttattgtctcgcagatctggagggcaggagtcccattccacatttcttgcctagcttctggtagttgccagcaatctgtggcattcctcgccttgtagctgcaacacttcaatctctgcctccatcttcacagggccatcttctcagtgtgtctctgtgtctctcctcttcttgaaaggataatagtcattggatcttagactcactaaaatccagtatatcttgagatccttaattacatctgaaaagaccttatgtccaaatcagctcacatttacaggaactgggatttaggacttggagatatcgtttggaaggatactattcaatgcgatatagccttagtcaagttatttattctctctcacactcagtttccagaatggttgttgagagaaataaatcataaaatgtttagaaagcctctagcatcatggcaggcatatagtaagtgatcaatgaatattaattcccttttccaaaatttctattactcctttggtaggactttttagaaaacaaatacaatcttgttttacagagtaggacatttttagagatctagcgttacatcactatatgcaattagaaaccagcttccctctaaataattcatctgcaagacaaagatgaaaactttgataagaaaggggtcagccaggtgtagtggctcatgcctgtaatactcgcaatttgggaggctgaggcgggctgatcacctgaggtcaggagctcgagaccagcctggccaacatggtgaaacgttgtctctactaaaaatacaaaaaaattagctaagcgtggtgctgggcacctgtaatcccagctactcaggaggctgagtcaggagaatctcttgaaccaggaaggcggaggttgcagtgagctgagatggcaccattgcactccaacctgggtgacaagactgagactccatctcaaaaaaaaaaaaaaagggggtagggggtccacacaaaaaccagacaggcctatttttttcagtctataaatatttactgagcaactactaagtactaaacactgaccaaaagagaccagtgaccagtcatcatggaaagatataaaatcgacaataacacaaaactatgaaatataatttcaagtaatagtaaataaaatagagacaaatgaaacaggatgaaaagatggagcactttgaatggcaggagaaatgatgacctttgggaaggtaacatttaaggcaagttctggataaagtgaggggtcatcccatgcaagggactgggggacacacgttctagaccagcaatcctcaaccattttggcaccagggactggtttcacagaggacaatttttccacagactacgggtggggcatactttcaggatgattcaagggcactgtttaccgtgtactttatttttattaatattacattgtaatatattatgaaacaattatacaactcaccataatgtagaatcagtgggagccctgaactcattttcctgtaactagacagtcccgtctggaggtgatgagagacagtgacagatcatcaagcattagattctcaaaaggagcatgcagtgcagcctagatccctcaagtgcacagttcacaatagggttcgcacgcctatgagaatctaatgccaccactgatctgacgggagatagtgctccagcagtaatgcaagcgatgggaggtgcctgtaaatacagatgaagcttcactctctcaccctccacttacctcctgcctaacaggccatgcagcggtatcaggtggggacccctgttctagagagaaggaatcgcaagtgcaaagcaggacagtcagggtgtgtaaggcagtggggtatggggacgggtttggaggaaggcaggagctcaatcatgtagagcctggttggccagggttgggatggggccatcataaatgctggatgggatccagtgtggctggcagagcacagggtttgagggcaacagctactgctagctgtgattcagaagggcagtctgcagtgtgaattgagaccactgtggctggttctccagacactggtacagctgtctaggatatgcagaacttttgcctcgttttccaactctaggttctctctactgccattctctttgttcactacccaaactgtcctccaaccacaggaatgtcaccagctctggatgcttgttcttgctctctttattttatttttgttatctgatagaagcagacagtaatactctgagatacttctaggaaccagtatatgacaagagatgcatttcaccctgtcagttcctccagcacaaatgacatgatagtgcttttctaaataattttgcaataattcgaaatcctgttcctccaacacaaatgacatgacagtgattttctaaataattttacaataattccaaatcctgttaaatcagtgcatacacttctgtggattttactgtctattcacctgaaattaaattctggtgggctttgctgcacagttcacctagaagaggcacaattagatgcaatctcattctagtctgacactgctgtgctaaatactttcattaaaaactattttctcaaagaataaaagcaagcataaaaaataaaactaggggcctttccataagagaaagaatagagattgagaggaatgggaggaagggatactgagtgaagaaaagctaaacaaaagcatggaaagtcaaagaagcacacacatgtgtgaatagcatcatctaattgtcctataatgaattgtcctatgtcagagcatgcctgtcaaattcttctaaacttctctaggcaggcttagaaaggtaataatattctagttctcattattgggaagtcacaatcaagagcaagtgaattgaatgttaaaagtatgagtctagctgatattgatagatcaaatgtaatacaacagcatgtgacacttattagccttttggtcaagctattgggcatggaacacattcaacatgcagtaacatttattgagcacctacagtatacagtgccatggtttgagtaagggctctgtggaatggaagacatatcctctgtcctccagaagtgttcaatatcgattctgagtcatttcctgtggccttcactttttcagttcttcatatctactttcttggaaggtattctcaattaaggcccaaaaggctgcacataaatttaattaaggctggaagtggtgctagacagtggaggagcagtgagcctgagctgcagccaaaaggaggaataatccactaactcaggagagcaccctttcttccccagcaaatgcccagtgcactctttattaagggacactgtgctgtgatgagctgacctggccacagggtgtcacaactgccccagggactcctctacaaactcaggagggagacaaggtctgaaaggtcagacaccagcagcttgtcgttccctctcctgcccacattgccaagtgagtcagccctgagtcagcccagctgctcaaaaatcatctagaatgtcacggctgccagggcctgacagaatgccttcagagctgcttaccaggctctgtgtggctcttggtctaacggaggggatcgacattttggcagtgcccgtgagtgagatgaaggactggtgacagccccacacccacgcagcaccggctccctcatagacctccagtcattcgaccaggtttgttcctggaaggatctgcatcatttatttggagaaggaccaggcagggggtcaagagacaatgattttagtgtcggctctgcctccttcaagttggggaccttcagccactgaatccacagagatgggcctcagtttcccaatctgtaaaatgaaggtggatcctttcaacttctgaacattaatgaaggattggccatgtcttatttggttagacatttcaattactttctctttttttggctctgacagcctccaaggtagaagaaattagcgtttttttttttttgtttttgtttttttttttttttacaaacacagaaactgagggcctgtgagactaaaagaaggtaatcaaaagagaatacagaggagacattttaatccagatctgtccagattaatcccactgtaattggggtgttcatttacaaactacacacaaatgttttgtgactcctgggaactgagtttcagacatgatgagatgaaagacacagagaatatatttgaataagtctcataaaaagtaaattctggatctttgggatagaagctaagggatatttgtgaatcaaatggtagtagcaaaatgggtcaagaatggcaggtaaaggataaacagaagagaaacacattttaataatactcaaccaatatttattaagtttctcccctgaaaaagttattgttcagggcagcaaaagacatgcaaccctagaggcagctgagaatccagccatgccaatatccgaatgcaaataaaagcaagaaaaagccaggaaaaagacaagcaaagtactgcaggattcaatcaagaatcgaatgaagaagctgtatcccattggtggaacttggaaggcaccaaggagaaagtttcaattgagtcataaagaatagtagagtatcaacaggtaataacacaaaggatgagctagctggaagaaagagatgcatgaacagaagtcaggaaaaaaagggttgcatttgattgtggaagacagtgtagcaattcctcaaagtcctaaagacagaaataccgttcgacccagcaatcccattactgagtatatacccaaaggaatataaatcattctatcatatagacacatgcatacgtgtgttcattgcagcactattcacaatagcaaagacatggaatccacctaaatgcccatcaacgataaactggataaagaaaatgtggtatatatacaccatggaataccatgcagctgtgaaaaagaacgagaccatgtcctttgcaggaacatggatggagctggaggtcattatccctagcaaactaatgcggtaacagagaaccaaacacagcacgttctcactttaagtaagtgggagctaaatagtgagagcacatgagaggaacagcacacactggggctttttggaggctgcaaggtgggaggagggagaggagcaagaaaaataactaatgggtactaggcttaatagctgggtgacaaataatctgtacaacaaaccttcatgacacaagtttacctatgtaacaaacctgcatgcatacccctgaacttaaaacttgtttttttttaagaaaagaaagggttacatttggagaacagtgaagactattctgttgaagtgtgtaggggacataggattggaaaagttcctctgaaatcatattgtggagagccttcctaaaagacaattttgagattggtggacaatggagaaccaatacaagagtaatatacttttctttttttttttttttttttgagacaaagtcttactctgtcccccaggttggagtgcagtggcacaatcttggctcactgcaacctctgcctcccaggttcaagcaattctcctgcctcagcctccagtgtagctgggactacaggtgcctgccacaacgaccagctaattttttttttttttagatggagttttgctcttgttgcccaggctggaatgcaatggcgcaatcttggctcaccgcaacctccgcctcctgggttcaagtgattctcctgcctcagcctcctgagtagctgggattacaggcatgcgccaccacccccagctaattttgtatttttagtagagacagggtttctccatgttggtcaggctagtctcgaactcccgacctcaggtgattcgcccacctcagcctcccaaagtgctgggattgcaggtgtgagccactgtgccctgcctgatataatttttataaagaagtttttgcctattgtctgggcatggatgctggaacaggagatgggatgccagaggagaggttagtaaaacagtccttaaaataatctggtggcagaggtgagaatgaggaggtgttagagataccaaggtacaaatgtgaagacttggcctctgattaaacacaggttctggagtattagagacagggcaaacagatggtggagtttttaagcctcagtgggaaaacgaaggtgctgttaggataagcagaaatatcataatgagtggcaaattccaaaaagcttacaagaggaaatacataaagagaaaagaagtatacaaatggaacattgggaagaatttatgtaatgcagtgaaagaaagaaagtaaagctaatgaaaaagagaaaccagcaaccagggtatacagttaggaaggaagagagagttccttgaagaaagcagcagggtcagtagtggcagggacctcaggggttgagaaggattgagacaaagcctttggaaatgctgtgatgagtgctgttttcacatctttgccattttctctgaacatagagaaattctgtctgtgcctgtgtatttgtagcctccaacacagcgtcctgcccatcaaaggcgctcaatgaatatttcctgaatggagaaaggaaaacacagacacggggctgtttaggagagctgtaggcatggaaacaaaggtgttaagagggagtgccttctgagtcttgcaggtgtcctctgtctttccaaatagttctggggagaaggcagttctgggctagtgcagtccttccagaccttgagcatgcatcaaaatcacctgtgggtttgttacatagcttgctgggccccacccctagagttttcgatttgtaataataggtctgaagtgaagcccccgcatttccattcaaacaggttcttggatggtgcggaggccacaggttcagtgatcatgctttgagaacccctaggcatgtgaaaatatccctgtatattcagttaggagacatagtttgagtcccaactccttattggctctttgccttgaggtatttctctctgcctattttctcatatgcaagatgagggtcttacctagaacatagcactgataggcgcgttgaatgaaatctcagtacttgtctaaaacatgtttattgaactaattttttttctttaaaaaaatttttggctgggcgcagtggctcatgcctgtaatcccagccctttgggaggccgaggtgggtggatcaggaggcaaggagatcgagaccaccctggctaacatggtgaaaccccacctctactaaaaatacaaaaaattagccaggcgtggtggtgggcgcctgtagtcccagctacttgggaggctgaggcaggagaatggcatgaacccgggaggcggagcttgcagtgagcagagattgcaccactgaactccagcctgggagacagtgagactccatctcaaaaaaaaaagttttttgtttgaaatttgatttatttttaaatgtcttcagctttaccgaggtacaattgacaaataaaatgtatacagtatattaaaggtgtacaacaagatgtttgatatacattgggaaagagtcatcacaatcaagctaattaatatgtcagtcaccttacatcgttaacttttttgtgtatctgatgagaacacttaagatctggtctcagcaaatttcgagtataccatagcttcttattagctatggtcaccatgctgtacattaggtctccagaatttactcattttatagctgtaacatttacagctgactaacatcttcccattttctccaccctccagctcctggtaaccaccattctacttggtttctatgagttcaacttttttacattccaataaacatttttaagaagataaagattggttggagcttgagaaagtaacaggaaggaaaaaaatgtgtttattttgcttatttaagaaatgccaagatgcatggcaaattcatgtttgctgggcaaaagatttactctgaattaatggatctctgtggaatagcagttaattttagagctggcatgagtcttatgattatctgcatatcggtcagtcagtttgtctgtgtgaacaggacatacgaagcctaaaggcaagctttatcatcttgcttatacaaagttaactatagcactcaaaccccacacattcagaataagaataaaataacgcaccctttgaatcatacataggtatgtaatttgcttccaataaaaatggagatgaggttgcagctagataaccatcagcttcgtccaaggtacaaaggtttaattttttatgtttgcatttagtcatttttatagtactggcttcttggctcatttctgaataaatctaggcagcattgaaacaaatgccaaagaaacaggaaaaaaaaccctctcagaatttcccgttcatatttatagtgagttgacagatattgcatttcctttatttcaggccctaatcaattcattgctaaaaggaaaaaaagagaaagaagaaaacagatgaagaggaacaatttgtatggggcttctggtcattacccttctgttataactctccttagtagaactaattagcattacattaataaatataagaatagaggatatggcagccaaagcagatgcttattgcaattgcagatacattgctgccatttgcttgttaaattcagcatctttaattctgcaatgtggtgctttgaagaggatgaaaatttctccttatatgaatcttccttctatgtggtcaggatgcaagtcatagggtgaggcaaagtggccatgtctgtccaacttcctttgtgtacaaggttaatgactgtgttttgtgtctatccctcaggcattatgaatccagatccttcacattctaatcttgctcgcctcttggctgttggtgagatggtggccccaacactgacaaaaagaaccagcctgttccatgatagtttctgtggaactcagcgttggtcacttgtgtcactgtaccaacagggacacctgaatggctctgtcattaataatggaatggagagccagagtgcaaaacagactccataggctgactcccacacttacgggagggcaattaagggcaataagtgctaagatgcaagagtgctgtgcttctcaaaacattaatcttatgcaaagaatcacctgggcattgtgttaaaaagcagattgtggctccacaagctctcacggatgcaggtgctgctggtccatgagccactctttgagttgtcttaattcctttcccttctctcacctgagccagaggtgcatttcagcttcttcaatttaaccttctgtcttctgtgacaagaacaaagtgagctctgctcagatagctcgagaggacaacatagctatttttttccaaagtcacaaataagtaaataaataataggtaaattagcaggattgctaaaagccccttaatttttcctttcaaaatgtagaggtaagtaaaagcaaatgaaccagattcttggatctgttcaaacccggagagcgcaccaacagataacatgaggaggtgtggagcaacgtgctattttaacgagcgcctgagtgcaggtgggctgaggcctaaaatggcgtcagcctaggtgaggacaggacagaggttttatagcctcctggaaacaggaagtgtcctagtctgacataactgctacttggtacctggaaggcctctttctccatcttcaggggtgtctgccagccagggtaggtgtcttccgtccggctctcttcctgcttctgctatcttgctgacacacgctggtgacacaagtggccttgggccttgggaccaggcctgagaagggaggagttattcatctccttaagctttcaagtccctgggagaatcttacagtttcctcttgtcacagcttccttaggaggaagtagggggagacgtaggtttggggagaaaaaaaagtcatattcattgagcactctttgtgctatgcttaacaaacatttcaatttttaatcttagcaacagtcttaaggggtcagtaacagcataagtcaaagataaaggaactcagaggggctgagagagattcagagagattgtgtgacttgccaagagtcaagtttactgggaagacctaaagcccatattcctttatttctaaaatacatgtttctgacttactaattctttgagacctgtagtttgagttgaggcctgctggcatcttttatttatctcttgcatcctttctcatgagatgtatggggcagcctgctaatggaacctcctggaaggatgaacacactccctgatgggaggtgtggttcatgggagttcccagggagatgcagaagaaggctgtttagggtagctagagggcccagtgggttctcatagccaaccccaggtcctgaatctgttcctatctgaatggagcctagagcctctttctactgcctctgcctccatccccttttgttgatggtttcttccctctgttctcattgggttccctgcttcgtactagttttaaaagttaattaggtcggccaggtgctgtggctcacacctgtaatcccagcactttgagaggcccgaggcagaaggatctcttgaaaccaagagtttgagagcagtctgcgcaagcctagggagaccctatttccacaattttttttttttttaaagttaaccaggagtttgagggcagtctgcgcaagcctagggagaccctgtctccacaatttttttttttaaagttaaccaggtgtggtggctcacatttgtagtcccagctacttggaaggctgagggaggaggatcacttgagcccaggagttccaggctgcagtgagttatgatcatgccactgcactccagccagggtggcagcgcaagaccctgtctttctctttaaaaaaaaaaaaaaaaaaggctggccaggtgcagtggcttatgcctgtaatccagcactgtgggagactgaggcagggaaatcgcttgaacccaggaggcggaggttgcggtgagccgagatttcaccattgcactccagcctgggcaacaagagcgaaactctgtctcaacaacaaaaaaatgttaatcatgtccatttgaattacgtagttgcaactcatgagaaaggaggggagttttgtagaccactctactattcaggttgttcagaccttgcttctggatgtctcatcaagattctcagattctctcacttccaaccttactaccatgacaataactaaatctcatcatgtttttttttttttttctttttcacaaaggcttccttctctgtgagctcaaactaacccatgtaatttttaggtggtgttgcctataagtaagggcttctgagcaggtgtattcattgccactgctcttaagatgcatgtgtagtgttagggatttcttctgccagcgtagttttgtttttgcagttaatttgtaaaaaaggttttgctaatactactgccttttttgtttcttacctttcttgtcattatggataatttttgcttcaaactaaccatacttgattcacttgcatagttcaattattaaccaaaaagcctacaaaaacacaaaagcaatatttgaagacaaaatggatgagaactttgtagacttgatgaacattgtgaaatgtaacattaggtagacataagccattctttatatgataaataaaaataaatctacacttagacaagtagtaagaattcagaacaataaagacaaagaaagtatcttgaaagcaactacagagaaaacatagattatctgactaccatttaatacttacaaaaaagtggtgcagctctgaaaaaaaatgctgtgttgtgtgataatgaatggatagaacttaggtgaatgttagcttttatggtttcttgcacacacgttaattattacctatatcattaagacatatcagattagttttgctgtgtttggttgcaccatgaattttttttatgtaatatggtcacctgctgctaagttaaaaaaatctctatcaacaggacctgtttatgaaatgatatatatactgtaacatttgacatcatggatcatcttttatgtactttgtttactgggaagtacttagaatgctacatatatagtgaactctcagtaaataaatactgctgaaagaatattagaatctttgctccttagcagaatttttattttaaattttgatggttctttatataggtgttttctaagtggaatgaattaatcccaagggagtaaaaaagatcattctctgaaatatttggaaaaaaatgttagaacttctgtcttatatttcaaacatattttaggggatgtttcatactatatgctatctttgtactgtattatacacagtaatatgtataaatacaatattttatgtgtgtgtatatatatataatgtatatatatataatgtatgtatatatatataatgtatatatatataatgtatatatatatataatgtatatatataatgtatatatatatatataatgtatatatatataactttataaataatccaccacacataaagtgaggtgaatgctcaaatgctaataggcatgcacaatcaaaagtgtttggaatgcaaatcaatatcagtaggagataccacttcacacccattaaaatggctgaaataaaaagacagaaaatagctagtattggcaaggacgtggggaaattggagccctcatactctgatggcgagaatgtaacgtggtgaaatcactttggaaaacagtgtggcaattctttaaattgttgaaaatagagttactatatgacccaactcttccatggctgggtgtatatgcaagagaagtgaaaacatatgtccacacaagaatttgtatgtaggtatttatagcagcgctatttataacagccaacaagtagaaacaaccccaaagccggataactgatgaaagaataaacacaatgtggtatttccatagggtggatttgatggaaaggaatgaagtactggtacatgccacgacatggatgaagcttaaaaacattgcgctaagtgaaagaagcccatcatgaaataccacataaagcacaattctatttataggaaatgctcagaacaggaaaatctatatagagagaaagtggattactggttgcctggagctagggaaatggaaaatgggaagtgtctgctaatggatgtggagtttctttttgaggtgatgaaaattttctaaaattagatagtggtgaggcctgtacaactctgtgaatatcctaaacaaacttgtatactctaagagggtgaattttataatatgtaaattatttttcaataaaaccatcataaaaaagaaaaatgtgccaggaaaccactactttagataaattcacacaaacttgatgaagctaatataactgaaaagactctggcaataaaaatgttccgtttcatttgcattatgttgccgcatttgttttatctctctttaaatagcataatctctaaaagacattttttttctttaaattatctctataagcattgacttaacaagagatggcatgtttcattttgtgtaccctcatggtgtctaaagggaacgccactagatgtatattgaaaaatgaggacattctgcataaacaaaactgataaaattgttttatgaattaggagaaaagtaatttttatcagatttgtaatgatatattctcatttaagaggctgtggagaagagaaaagaatgagtgcttccttcatattttcttcttttaagactaaaagaactagagtttacccataatttcttgtcttgccctattttgggtggcaggggatataatcatttcttctttctcctcctcctccccctccccctcctcctcctcctccttcccctccccctccccctcccctcctcctcctcctcctcctcctcctcctcctcctcctactcctcttactcctcctcctccttctcttgcccctcctcttattcctcttcctcctcattgctgtgtaattatcaagggcaaagtactgttgccctgaactgcgattcaggttgctgtggaggtaacttagaggaacaactcactgttttggctctctgttttgaaggctaatgtaacagactcagctcaacaagtgatattcctgccaggctggacgtttaaggatcctgatgtatttgagagttgtcttgtgttcttactcaaggaaaagtaggtgtgctgggtctagcagtaaatacagcttttgtggggccttcatctaataacattcgggagttcctctataagaaaaagattacatattacaaatataaaaatagttacaaaagtgaatatttagagtgacaaaagatatcacccatcacataggtcaacatgctgccacattccaacatgagattaaaaaacataatttatttcaagcattgtgtctcattcctctctcctctcagtgccaactgccaaaggagttatcaatagaactcctggccctaacttttgtgtcccaacattgggtgagtcagcacagttggagataggagagttattagaagctctaatggtgggatggtagccatgatttaatgacacattggattcactatgaaccatataagtgggtaccactcaccatgaactaaatagatccctaaatcatctcctcctcagtgtgatgatcaaaatgtccaggaacactgctttaccataccacatgaggggaaatatgatggaggggactggaaaagtggcagtatcggagaggggagacagcacagtgttaattcattgctgctaaaatacccacttctacaaattttataacagtagggccctggaaggagcctgttagcaagggcccatgaaacctcaccttctttagtttcttaataaatatatctccactgatgctctgtttcagagacattttatagatgtctagtcaaagaagtccattttcaccgtttcatctggacaattttacaggagtaatgatttcaggacattttgaaacattccgatttaaaacatacagagaagacaggagaggagaagaggggacatgagaaaagtattatttaattcatcaagatagttttttttttttctggaacatctcctacatttaaaaaaaattcctattaggaagacacagagtaaaactttttcccttatgaaatacattttaaaacaaattcatcacatcctcactgtaaggagattattagattactgaatcactgtgagtcagaaatttttaatcttatcatattggcttacagctttgcatggaaccaccagtcatatatatatatatatatatatatatatatatatatatatatatatatatatatatacacatacatacagaaaggcaagagaagattaccttctttaatacatttaactgaaacactgtgacatcacctatgatgactcataggcacaattcaattgtttcatccattcattacatatttatcagtgccaattatatatagggctcttgctggacttaaggtggatttagagatttataagaacagatctcatcttcaaggagttcagatttctttttaggcacaaccaggtatgtatacaagtaactatcatagaaatgctgggtgacaagcagacataaagaactgtgaaaattctgaagtatgggagcaccatccaatcatttattcgatgacagaggatggacaaaatatatttggtacctgccctcatagagtttgtaatctagtgaggaagatgcacattacacaacacaggacatacacaaatatgtaacctataaattgtgatgtgttaagaaaaaatagatgtaagaggcaatgaaacagagtcctgatgaagagtggagggtcatgaaaagtgtgagaatgtggcatgtcagggagagctaagtgctgaggaggaatgacctgggtgaaggaggataacgtggattgtttcaggcatagagaaacacaaatgagaaaggcactaaggaagaagatagcttgatgagcttgaagaacagatgaaggtgaatgaggccgggttatagtgagtgagggtggcagaagatagttcagagaggaggaaaagaagctaaagtgtcaaggaacttaaaggcgtgttaatgattctgtgctatgggaattctttggagctacaaaaatattatgtacaatataaagtatggattggaagcagaaagcagtactagcaaaggctattggggtcatcccagggaaagatggtggcttggagtaggacaaaagcaatgagggtggcaggggtggtggtggtaagaagcactcagattttgcaggtagaatcaacaagacttgattatggattaaacagggagaatgaaagagaaggaacacaccagactgtttgcttttatattgtcatctgaactttgtcatgagactgtaagttctttgaggcagtggacatgctttctgcctgatctgtgctctttatagcatcaaagagggagatggtgtttggaaaatattaatttgcaatttgttttcccaggtagaaaatctagtttctctatccttctgcccctcagggctctcatgttttttccatccctgtgtatttgcttcctgataggacctcagaggaagaacaggaaaaaaaatcctttatacttcatacttcgggactacttctcatcttctttcaacttggcacaggctagagacccagaactgctcctgcccttttgaaaaaaatcctacaatggtggccatcttaaaggtgctattcaagatagtagcagttggtagcccagtcaagttaaagaaatattgcaatacaacagttggtatcattgtgttttgtgtagtgaccagatggatgtgcctttaaaatgtcttcatatgccttttgaaattttctatgaatacttcaatgacaatggtgtgggatctggctctttgtaatgatcttccaaggaagcgatgtgctgcattttcacttgcatctgtatcacctggtccatttcaagaccatgggtgccgcgttcaggctgccatcatattatcactctatcttgtggggaagcaggtgtgggtagtgagtgttgaggaccaagcagttgctctggtggggtctttggacttggtggatggccacagctgaggcagcattctcctttatctccaagactcctgtcagccccacactttgttcttcacatgcagcttcagtgtctaagtaatccgaatagagagcttgccttaagaggaggccaggaggacttagtggggagatgaggaacttctgagagaaagaggaaaatgaaagaagaggtaaacataggactgtattagtctgcaattgctgagtaacaaatcactgcaaaactcagaggcataaaacaccatacatattatctcatagtttctgtgggtctgagtctgagtgtggctcagttgggcctctgctttcaggacctttcacaggctaccatccatgtgtcagctcatcgtagttatttcaggtttcaacttggtagcaatccacttccgagttctctccgtgctggtagacgggattcagtttcttactatctgtcggctggaggccactctgttccttgccaggtgggccttttgcttcattgatgctgcagctcacttcatccatctaggcaagcgagaaggcaatagagtatgagcaaggtggaagtcagtcttctgctacttaaccatagaattgacatctcgccacctttactgtattctattggttagaagccagtcactagttccagtccacactcaagaagaggctgttacacagaggcacaaatacaggagatagagatcactgagggtcatcttggaagtctgcctaccacaatgaccttgcactagatctacttgcaaatattaaaactgttgtggtacagtgaaggaagagcaggagtttctttggtaagtaccttcacttctacatggaagcaactccaaagtgttactctggtataactctgatccaggattagattaatgtggtggccaaagaaagagtctggtggctaaatgtgatttcagtggactcaaattatttactactgtttcttaaaaatactatgggggccatgcatcttctgtgccacacctcctctgaattccagtttttccctcccatctacttaactcataaactacacttgggttgctccgaaattgctctcttcctacctcccccatacagcttcccgggtctcttgtcctttcttccatctctagatgacaaatgtccactgacaaagtctggctgcagcacagaaatggtctggcaactgctgatccctctttggggagtggaggagagcaatgacctgagcaggaaaagcaagttctccttagcaggcaaggaaggaggaaagccgggaaacccatgtatattaatattttcagcctcatcacattacgttttctgggtgcaggtttttatctctataaccaggctgcaaactccttgaaagcttgtccttatcttctgctttcttgtatttcccaacagcatatgtgggaccgaggtttgctgaatggatggtgtgtgtactgggctgtgacattttttccagtggactggtgtgattgaaagagataatgtgtctgaaagtgcaatgtaaattgtaatactctatatacatgtcatagttattattgttactatcagcaccatcatcatcatcctctagcacatcttttatgcaccatctgcaaaaataggctttttcctagatgaatgctccacctagaccaccaggatttaagctcaacaaaatagacaaattccttccaaagatatatttatgtgtcattcctatgtttataaagtccagaattataatagagtgggaatatcacatattatggcatgagtgtttctaaatgttacttacactttctgattggaagagcaatcagatatcttttataaaatttagaaatagaaatgagataatagaagaaaccattgttaatattttaccacatttctgtccatccttgtgtgtattaatatataatacatgcatacatagatttgtgtataggtagttatgggtataaagatttatgtgttgctgtgtttatagtctcatgagcaatttcctatgtcattaaatacatttaaaactattattttgttggtaaaataatattccactcaaatatatgtaataacaagtttaaccatttctctactttttggagatctaagattctgtctctttcctaatatgaataagatttcaattaagatttggtaataagtcattgtctacagccctagttacttccttaggaattaagagtttaattagtaggtcaatggtatgaccttttaaaatatatttataaatctggcaaggcatttttctgaaaataattagccagtttacatccttccaagagtctagaagattgcctctcttatcccaccctcagtgacaatgaataatattaatttaaaatttctgattatttgatacaaaaatattcacacttagttttgtttttattttttaattactgaggttgatttttttttttatgtgccttttggccatttgcatttattcttctgtgaatggcttagttacctcttttgaactcttgactttgaatgagtcctaatgttttccttcttaattgataaaagatctttaatagcttattttcacctttaggctatcgtactacaattatttctttgcagttgtttgccttcaagattttgtatatgatgtttttgacatgtaaatatattaatttcttaagtaatatttattcaggctagtgtactatattgaactattttccaaaaattattgtgatcacttatttttattgtaaaatattttgtgcacaaatgaatgtataaaatacacaaaacaatatacaaataacgtatagaatatatgtgcgctgtttaaagaatattggataaaatgaaagctctagtttctaccactcaattttttttaaaaaaaaaagcagtgccggtagttacctggcagcccccatgagaactccctagtcacacaattctcctttatttccccaagttaaccactctcctgacttttgtgagaatcatttttctcctgaatttgtgaattgtatatatttaatatttaatcaatatattgtttggttttagtttttcttgtctttggactttatataaatgcaaccacagtgtgtatatttttgtatcatttcatgcctgtaatcctagcattttgggaggctgaggcaggaggagtgcttgaagccaagagtttgaaactagcttgggcaacatagtgagactccgtttctgaatttcaaaaaaagacctaaaaaaaccccacagcttttatcagtcaactatttttgcagcaatgctgtgtagcaaactactctgtaactcagtaacctaaacaacaagcattcattttcaggctcatggatgtgcttggtcagttgtgctttaggctagggcttgggtgggcaggtctacttcagactgtgaaaggacttcaagcctgctccatatgtcttttcttattatgtgattgctaccttgaacttgttctcatggtaatgagaaaagtgtaagagtagactagtcatacttataagcacatttgatcactgcttgcatcatgtccacaaataatcttttggccaaagcaaatcacacaagctcaacctcaatgaaacagggaaatatatttggatttctagtggtgactgtaaagtcatatggaaacaggaatgcatgtaagctatataaaactataatcagaagggttgaagaatttggaacaataaagagatctgccatgcattttagccttcctaaagtgaaatatatcttttactcaatagctaaatttattgtcatgcatctcattccctgtctttttctttttatggttaatagtttagagttaatagtttatggctttacaattaagtgtttaagaattgacgagacatggtaattaacagatattacattatcattttttttcttccagcgtttcactatagcaagatattggctgttagtttacagtgaattcttttaaaaaaaattgtgttaaagagtattcatatttctaatttaataagaattttaaacaacatgcaacttttgtcttctgaaattatagggataatattttctaaaatttttacttattaaataatatttaatgttactgaaattaaaccacttttacaatctgagtataaacactatttattgatggtgaattattccttacatccttttgattctatttgcttggtttttatttaagatttcacatctatgttcgcaatttcattttattttcttaagttttataattagtgttgtgctacctttaccaagagcactgggtagctaccatctttttctgtgctttaggaggactattttattttattttaatattacacatactagaaaaactaactcatactgttaaaataaataaatgtgtttatgcactaatataccaggatggtaaataggtagagcgagtttggggttttgagattgctttaaatcaatgattatatgacatcaatgacttggtttctttttacatctcaattctgacttctggggtggcaaactttttaggctggctcactgcatggaagcaaaatggctgcagcaatttcagtcatcacattttgtagtacgttgttcataaagagaaagatgggctggctccttataagctcatataaaaaagaagtatcttattttgagaagtacacacatatatattcaacatatatagtcctagaatatatatctagtcacatactttttcatgtttattgatcaatttaggtttcatatgttttatgaaatctgttttgtaatttatatctattccaaagataacctttattttatcctgattttaaaatgtttgccaacattctacttgcaattctcctatttttaatctcctatatgcccctatatttgctgccatagccttgattttctttgtgaatatgcataatattgaggacttaatttgacttaagtactttgaaagaaattttacgtatattagcttgtcgctaacttctctttttttcttaattagatttataggacttgtttaattttggggttttgtctattttttaaaaagaactgattattggatttacttactctatctgctggtttacatatttttcagtaattagtttgacattttttaaatacattaaatcatttttactgcattttattattttctccttttttcttgaagttgactttatatttctaaatttttaagaataaaagttatttaatgacaaagtatttaaggattttatttatgcaggtttacatttgtcatgtggacatatctaaatagtttactattttgttatgcatttactctttaactcaacaggcccttagagaagagcagctttcaacttttaggaccttgtaaagttgtttttcctatttttactcttacttaatcttgaataaataatgcagtctatacaatgtctaatttgggtgacttattgcagttttgtgtctcagtaaacaaaaaattttaaactattctttggagacttaaaaaaatttaacgtttaagtggtataaacattaaatatactgtatgtctattcactttatatgctgattatattaatctaatcatcactatttctatacattttgactactttattatattgtgaaagtagggaattaaagcaattccaattatatttatctcaatttttaatttcattttattttgacaaataattgcttgattaaacagttggtttcagattgggcattgtggagtacttggggaggctgaggcaagaggattgcttgaggccaggagttgagattagcctggcaaacatggcaagagcccgtctctacaaaataagaaaaaaattgatttcatgtgtaatatgtgagcacacactcacaaaatcagcacctaagtcaggacttacaaacttaataggtcagcttcctgcttctattgagtcactaacactcacaggtaattgctatccttaattctaacagcatagataagttttgtttgtttttgtaatgtctcatgtctggcatctttcattcaacattagatttggtcatgtgttttgtgtgatacattctataaaacaattggcctgaactcaaaaaaaaaaaaaaaatcaatatcatgaaagaccagaaaagcaaacaaacaaaaagctgaagggcttgtctacattaaaggagacgtggctgggcgtggtggctcacgcctgtaatcccagcactttgagaggtcaaggcaggtggatcatctgaggtcaggagtttgagaccagcctgactgacatggtgaaacctcatctctactaaaaatacaaaaaaaaaaaaaaaaaaaaatagctgggcgtggtggcacgcacctgtagtcccaggtactcgggaggctgaggcaggagaattgcttaaaccgaggaggcggaggttgcagcgagcggagatcaagccactggactccagcctgggtgacaagagcgagactgtctccaaaacaaacaaacaaacaaaaaacaaaaacaaaaaaaaggagaagctttgatgaacaaacatatgatttaattagaaaaaaattgaatatcaacatgttaatattatcttcttaatgttaaaacttttattgtgaaatggtgtggttatatagaagaatattcttgatcttagatgacaggatacatttaggagtcaaatgttttaggatctgtaagctattttaaaatagtttggtaaaagtaatatacatacatatatacttgtgtgtgtaaaaagagcagggaagtgtggcaaaatgtgaaaaattggggaaggacaggttggtgtccattgtattgttctttcagcttttctgtgggggctgaaatattttaaaattaaaaaatgggaagataagcacacattgctatttaatcctaatttttaataactgagcagtagattttctgttgtgattttatttagcatatgtagaaactgaggctcagtggagtttggcacattgcctagagtgtggccctgatgactctgtgatctaggtcttctgaccatctcctgtgcaccttttatgaaggccacaaggacactgttgactgacagttgagaaaggtaaaagctattaagacatcctagaattttagagtagatagaaactacagtgatcagctaatcagattctctaatcttagaaatgtcaaggaggtcaagtactcagtccaagttcacagaatgagttagaaatgtcagagcctgcattacaatcttggttttctaattttaaaatccatattatttttactgcaccaccaatgagctgaacgttccaagcagatagaattctgggccatggaacattaggacaacaaagttcaaaatcaaaaaccaaaacaaaagcctcaaattcctcagcttgcttttcaggtttaagcttgacttctgaccacatgtcaatcaggcattgttttcggcttgagtcgggaatattttgtataactcctctgaatgtgtaatatccctgctctctttcccagccaggttgggagtgtatcttggcgtgtagcagaatatctgagtgtttatttccccgtcttacatcaacagtttgctgaatcatttactttttctctttgacagagtttcaatgctgtcagtagaatatgcatcagggcagaagggaattatcatggtgtcaggcattatgggtaattccatgtaaatggttctgcagagagccatgctgatttgcacggcggcagtaacaactctaagtggaaggcttcctcatgtctggttttgttaatttcagtttagtggctattagcaggtttcctgaaaataggaatgttagaccctagacagtccttctcgaacttgagagtgctttccagtctcatttatcctcttctcatagaaaaggttttgttttcaatttctttgtttctattatcctcatctttctgtttacttttcctggctccctgcctaacctgagaggaaagggatgtgtctcatgttcccttcccacactcaagactctgtgccctgagtttgggttacacttttcttttttttaagttattgagtatacttgaacaatagtatactctgccccactataaataacttttttcccacagaatactgtatgcttttataggaagagctctggactgaaagtcagggggtcacaatttcaattttgccattagtcagtcctatgaccttgatcacattattttcatcactaaataacgttgagaaaatggaacgattctgccttcacatgtgtttgataggtggtgagtaattaggttatacatgttcattcttaaattatatatgaaaatacattctaaaagatatattttaaaaatcaacacttaattatccaggaaaagttgaattaatttttttcttagttttttaaagtgtcatgacatttccttattctgtatgacttaatgtatttgaacacattgttttgttgtcttctcttatgtgatcttctctagctcacataaaagactaacattttaaaacccatttttaaaatacacaaatgaaagtgtagcaaattaattgatttatataacattaattgatttatataacaatcaaccatatttgagctagaattaatagtttaaaaatcttaattttaatatcttttttttactgcataggtagtaaaataatgcatccaagataatttgtaaagtagaaatggacaataaaacatggacaataaaatcacctgtgtcctatatttgttaatgatctaaataaatgttgattatttactatatgctagctattgttttaaaggccaagaatacaccaatgaacaaaacagaaatccttgttttcatgcaacttagaaaatatgtaaaatatctggctgggcgcagcgccttacgcctgtaatcccagcactttgggaggccaaagcgggtagatcacctgaggtcaggagtttgaaaccagcctgcccaacatggtgaaaccccgtctctactaaaaatacaaaaattagccaaatgtggtggtgcatacctgtaaccccagctactcggaaggctgagacaggagaattgcttgaacctaggaggcggaggttgcagtgagccgaaatcacactactgcactccagcctgggtgacagagcaagactctgtctcaaaatacaaaaagaaaatatgttaaatttccaatatacaatgcacaataaatgcatgaatcatatagattactagaaggtgataagtgttgtcaaaagaatgaaaggaaaagagtttggaaattctggaagtagggtaagggtgttattgagaagatgaaatttgggtgataatttgaatatgtgaggacgtgagccatgcaggtatctggtggaagaaccttccagagggaggaagagtcagagccagggtagaagcatgtctggcatttctaaggaacagcaatgtggccagtgtgactgatcataataaggaatgagtagagtgttaggaaataaatagtcagagacttgctcaaggaccataacctgtagccttttaggtcatgataaggggtttggaattttctctgagagaaatgagaagttagtggcataatctgacttacattttgaaggtctcactcttgctaaactttgcgaaaactgtttgggatgttgtgggggaggacaggaaggggagggcaagagtggaaagagaaagatgaggtaggaggctattgcagttctcagtgagggctagtgatgacttcctatgtggggtgctagacttgagagtggtgaggatcagattctgaatatatgttgaaggcagagccaataggactttatgatggattagaggtggtgggtgggagaaaaatcaagaataatggagtgctctcaggtttttggcctgagccactggaagaatggagttccccatcaacagagatggggaaaactgtgagtttaataggtttggagcaggtggggacaatataaacaattggttctgcaaaatgttttgtgtaagatttctgttagatagccaagtagtaatgtcaagtccttagtcagataatgagccaagagttcaccggaaaggtctgggctgtagaagtaaatttgacttattcctgggacctttgttactaagaattgaagtgtagagactaacagaagacaataagaaacgaggtagaaggaaaaccaggagatgaactagtagtatagtgtcctagaagcccagtgaagagaatattgtaatgaagaataactgattctctgtataaattaaaatgaagtagatgaggagtaagaactggctatcagatttaatgaaatgaaggcaattgatgactttggcatgagaagtttcagtagagtaatgggtgtgagattataaaagaagaatttgaagtttaatgcaaaggggaatggagaaatggggccattgttggaaggaagagtgatatgaagagaccctttttaagagatggagaaatgataccatgtttgaatgctgatgggaatgatctagcagagaggtaaagcttatggtgtggaagagaggcaagaattgctggatggctgtccatctatgaggatgaggaaataggatctgatgcatacctgaaagaattgaccttaaagagtgtcatgggtagtttacttatagtaacaggagaaaggcagagtatatggaaatagattctggaaggggtagaagaggttgtgggagtctttggaagatctcctttgatagcttcaattttgccagtgaaattggaagtaagatcattgagaatgaagatggggaagaattgttgaaggttttagggggaagaaagaggtaagtaattgttcaacaagagagtaggagaatgaatgggcaaaagaaacatactgtgatgacttggtagtactgagtccactggaaattttcagtcatgaatttgaagtgagcccaatcagcagagtgatgtgtttttccctacctatattcagttacttggaagaatgtaggtggtaagacagcagaagctgagaatatatgcaaatatgtgattagattggctgatcatatcagtccaaattctgcataagaaaaaatggttactttcataattgataccttgtttcatttccttctatctttttaatgcacaggattaatttgggttttttttctttttacataaaaacaattattctggagtatgcccttttattcaacattctttttttttttggtggggggcttataatataatgcctatgtgtggtgttatatacaattaatgattgcattaatttttatttttacttttgtaaatctacctaattgtattgtcctttaaaactacatgtcagttcatggttataacacccattgttatcaataactcactcaccaatcaatttaaccatgaaaatggcccatgccatatgtctgacaagcattaagtcataggaccaaaaaaaattgggataagctttaaaagtatcattcagcattcttttatggacatgtaaaaatagtctagtttcttaataagctacagcatatatatctagttctttttgtggcacagggggcatttagttttgtgaaagagaccagcagtttttctaaaatactctcttctcccattcttcattagtaacagaatccctttccctgtttttagcttggtacacggccacctgaaatgaggactaagtttgccagcttccttattactaagtatggccatgtgaccatctttggccaatcagatgaaagtgaaagtggtgtttcagccatcagtcatctggcaccataaccttgacaatggaagctatataaatttataaggtataaggaatctatgtctctgacactatgggggatatacttctggtcaaaatgactatgaaagaaaaataacttcttttataagctactgttattgtggttttttctgggcctcacagatgaatttcagccatctgataacacgaaagtccaacatacctgttttttcctaagccaagaattctattgcttgtttttcttcagtccacatgagactctctgaaaataagagcaaaataaaaaggcattactttaaaaaggacaaagaaaaaaaaccctgaatttaaaaactatagggcaagatgtctgtaaagtacatatttgtgatcctccagcaactgtccttgaatcacatactggcaggcatacagtatcagcacactgtctagaggcttctttcccgagctccctcatctcccagacctatggattctgaatataggtgtaacttttttgtatcctgcagctagtcttgcccacgctactctctgccaaggacaaattccaagtaggtttgatttggggatttcattgacttcacagttcattggcagagcagtgattcttaaaaattctgtagttagtaaatcccttagcacttcttggttcaaatcctcaaattggctttcatctgagaaggaaattctgatattactcactgaagtgtctttaagacaccctttcctatgtttcctatattcccccaacatacaacttaattaagtagttctcaagttttaatcagcataaaatcttgataaaaatgcatctcatctgaccacagcctcagagttcttaatttggtagctatcatggtgaggcccaggattattcatttttaaccagtgttattccatgactctgatgtgggccctgcaggggtcacgttttgagaaattgcatagaggcctccaagggtcttgactcagacaatctaactagttataattttctagtacttctaaggctcatgctgaaaggaaagaacacttctgtatcaaagagataattcaaagaggattagattctggttaaaacttctctcactgtagaaacacataagaaatggcatggctttccttgctgtgtgaatttggaattgtatagatcttattataattccagcactgctacttattggctaagtgatttagatgagttatttggcatatacaatcctcatccacaatgctgttgtcaggattggaatgcctagcctggctcctggagcattgacgttcgtcagtaaatgacggtgttcctgttttcccactcctctttcttctcattttcttagttacatgaaacttcttgacccctccatagattgctaataagttccaactactgatctctctgagtgttgatatcttactaaacctgccactgagtacgttaactcttaacactgagttcagttgacttcctgaatgtctgacaaagtattgtcttccttggtccactgcttggtgtcagtcctggttgccccatctgagacactgtctcttgagctgtggtcccacatgtggttgccctacttccaccagcataaagtgtcattgagatgggggtacttcaaaagtctggggagtttttgcttgtttttctacagtccaactggactctactggatgctcagaagccttccattgtctgagattgtttaacaaatgagtgatcttcactaacttcatctattctttccccaatacaataaaaaggaaacctctgttaaaagagtaagtctgacacctgtgcttctactcccagtgcactctcaatttaaatgtcattttagggtcaaaagattggcagacaatatatggaggtacaccagttctcctcatgttctctttcaactcaagcatcatagggagcttcgcagctgtgacatgacttccacttagtgacaaaggggataaaatcaatttccatttctgtggttcttccagagaggcacagggatctcagcctcctaatgttgttattgttgaagatccaaagataagagctaggctttaatgttcgaggccagaatagaaagactggctaccggaggtttttatacttcctgatttatccattctagaaagatgttgtcaaaggatcaatattaacacaccgagatgtggtttagctgctttatatttcatagttatgtagatacctacctcggattgtagatttaaacatttgtttgggtaagacctgcctaaaactagcatactatccatttattctccttctttaaaaatcttccaatatttgtttctggaaccctattctgagactcatttcaagggtattaagttaatgaaaagtattgtgtttgaagttttctctttgaaatttcatgaatgactacattaaatctcccaaaaatgtatgtatacacacacttcagtgtgtgtaaagcagtggttttaagcagggagaaattttgcccccttttcacttcccctgccagagacatttgacagtatctagagacattttgggttgtcctaactaggtacggatgcaatgggcatcaaatgaggagaagtcaaggatgttgcacaatttcttgcaatgcacagaacggtccccataacaaataattttatgacccaaatgtcaatagtgctgatgtagagaatccttgttatagaccctaacaaatgcgttttatccatgagaatgtatattcattttattttcacgaaagattagttcacccatcaaccagttgggatattgccgagtagccttcttgcaccgtccttccataacctcctcaaatgcaaaccaaaatgagttatgtcagcacaaacatcccaggggatcctgatacacaaataagaaatagttagccctggcttgccaagctccctccacaccaagtcaatagtctcatcttaaattagagtccatacactgtgtccttcagtgcctgctcctttcccttctccctgccacccggagtacaagatgcagacttttccctaaatcctataataccacaaagcccctgctctttgtattattctcaagccctagcaggactttttgcactcaggcaaataaacacgccaccaataatccaataaaaccttcacagacatcggatataaaccacagtgatgagcagcgcacaatctatagctgcttggttcttttttataaaccgtgcacttgagccctgaaggcaacacaaatcaaagctaataaaagcaccaaggccttccccttattgttcctaatgggttgattcaccctacctatgccatccccctagtgaccacaggctgtctccactcccaaatggaagacatacaagccagcatatcaagtatgaggaaggaaagagctcatttcaaatatgcctttcatcatgatggctttccacttggtgctcaatagctgcagagaaataaacacgatcaccttgggctggaactagccaatgtctcatactcccagagaccaaatacagcacaacactcaatcctagagctcatttttttttaagtgtgttttccaactctcaactttgtgaaggagctgcaattagtctatgcagtaaatgaaagcagattagagcagaagaatgtgagtagtttgataaaaagcttgccccaaagcagaggtaacaggaaaccacagttagaatgttctttcttcacaggaaaacctctgtctttggtagaatgactgcagagtttcactgataatcaaaatgcgaagattttattctgagccacaaactcagatgtctctatgggccaagcagatcatgtacctgagtgaaaaaggggtagaaaaagggaaaagcaagaaggggagtctttggtcatctggatcacattccttgtttataatctctactcctcccctagagctctgccaagttgttagcaagtaggagtgttttttcagatcttcccatttttttcaaagctatataataaagacttattttgagtgtagaagcttccaatttttacatatgggtaagtaattgcatttagacaaaaaatgcatgggccaaaacaaactaaaatatatctgtgggctggaactattaatagctgtgagctaccaggctggcaccactctttacccatggccctgtatgcaatgtctcatccttgaaaatgaagttaatagttagtgtccattagtaccaggaccctaatcaaggctttacagagtacattgttgtattttttaagtttcatgtttagaatccacatacattcatggaaagaggtggatggcaggtgtcagggtaacgtgttggcatccccttttgtttcaaaccttctcctataggtgtcaccgatgctctccttggggaggactgtggtcattgacctcccagtccccttcatggtaaaccttttctgatgatgggccctgcctagtcagccagccatggagaaacaaagattacatacagcctttcctgactaaagatgccagtgagcatcaaaatcaaatgggagcttctcatagccccaggcaccgagagattgccactctggaatctctctcagtagggttatgctcttttataatgtaatatcttctcaacagctcctacttttcagagcagccttgcagaaaagcagttggaggtctgtttctgttagccaagaattcatactcacagcttgccagaaaaggtgatgcatctgtttataagggaggtaagggaagagcctactctatccattggcacaatcattccagatgcatctggtgggacaattctggggctgattccaatctccggaaatgcattcttccctgggaaaattattagcaaggagggacaggtgtgcagggcattcaaacagaccttccttttatttctgtttaaatcctgaatatctattaacaacttgccttcccattgttccccaacaattgaagcgcagctgaatacacaataggaaaatagaaactgaactagccaattgactccggcttctatttaactaccaatacacgcaatgatgtcctaactagtaaatatttggtagaaaatatgtaaacatataaataacactattgagtatctccaaactaatttttggaagtaggtaatcaataatttcccgttactttcttttctcttgtctttccttttctctcctcttcttccctcaaatatttgtaaagcatcttatattatgcgtaattctgtgtacatcgtacctctaggaaaggacttcctccccatcaaattcatatatgttgacaaaaagaacatacgcaattcaaaaaactagaaattgccctggtgtgttattagatgtccaataaatgttgctgttgtcacttgctgggagaagggaagtcattgctaacttgcagtggtcaggaaacacttcaagaaagtgtacaatttggatacattaggaggagaaatacctgggagaggtggagtagggataaacattatgaggaaagtctagctatgggcttcgtagtagttttgctgctataccacattactatagatggttagtgtgagttagaagaaagactggcagataatttaaatattggacaagttaatttgcctccctgagcatcagtctcctcatgtgtaaaatgggagtagtaatgcttacctccattgagatgctatcaattaagtgaaataagtaatgaaataatgtacggagcatgaagcatgcttccaggcccttttctgcacctgcagtgtaatagataaaatcatggaggtctttgtgtgatgaatttggacatatttctactggcctttgttgaggaaagttgtgatttataggaagtctttattctatattaaatacacataaactactttcaaccatcttaacaagtggcagagggtgagaaactatgtacaatattaaatttcatttggattatttgaactttctcttaatttgagcagaactagcattattagaaagaaagagcacgctgacaaaattagtggtgcttcaaaagtgcttagatatcaccctggggctttaggggggttgcctgcattatgtaggaaaacaacttcattacaaacccagtgttgtagagttctaaaggaagtaacttgctgcttgttgaggttctaatgacacatcactcttgtttattctttgaagggaatgtctagcaggcctctgtgtagccagactttggtagtgcactcctaagttctttatgcatcaaaaagtaataaagtatctcttaaaatatgacatagtctaatttgaccactgatgttaataatctggcttctctcccttctttttcccttatttattgaagatctctcccttttcctggccagaacccttgtgaccttcttcctttacaccccctgagctcccttatcttccattgtttaccttccatggaagagggttaaatgtactcagtggctcttttgcctccttagctaacatgagaagggtctgttcttttacctgaactccaccaaaaggaattccacatctccactggaggtttgaaatgcaaataaactgagagtagttttcatgtcacagatttggtttctctgctcccttcccttaggaaattgtatttttctttgccctggcttttacctgctccccagccctccatcttgcctcagccatgttggttctctggcccttatttctttttaagatcattaggtttctctcatgttaactgttgctgcttccaagaccctcaccttcctcgtttctcagtgtgatttcttttgctaatatgctcactgtctaccatgccccttccactaagccttcagcagcctttgctctgttcctccagaaatatttcatgaagtgggagctgacctgggacaatgccaactgtacaagtgccgcgggctgactgtgtgcctcctggccaatcagtttgccagccccggtaagagctcgtttcctcctgctccttgacacaagctttcctcacttcatgagagtttctgattagtattcagaaagagttttctctgatggcattagtgggaaatcagactgtcaatttatttatacccagcctcagggcagaaccactgtgtgtgggtaaagctattagatgcagaaaatactctgtgtgtgtttgtatgtacacatattgactggaggtgacgtttagagtggaaatccattgccccatgggttggaaagtgactcacagtgggatataaaaatgccggagaaagatttggtgttattgctaatggaggtcacattttcaaacccctagttaatggttttccctagaaatgctgtgtcctctatggataatcacagtataatttatgtctggacttgcttgctccaaacttaaggtggtggcctaatctcacatcataaggaaggacacatctctcgtaagtctcctacttctgagattgacaaaatgggctactggcctggggtagaccagaacagggaatagggagcaagggcttctgatgggccagcagccatggtgtcttggtgggaagcaccctggatttaggtttaggggagctaagttagggatgcaagtctcctgcttattgagaatacagagataagatgctcaacttctctcaaactcatcattaggactgttgtaagagttaaaatatatacatacacataaatatatataatttatatgtgtatatactatattgtatatgcatatatatatgtatgtatgtgtgtatatattcatgtatttatgtatgtataatgaaagaacatgatcagcacaaaaatccaggttgggttggattcccttaatgtattctcgtagcatcctgtagtttttggtcacagcactttcaaaactatcatgaagcaattaataatgtaatgcctctagaccaagacaattattaaaatgactcctctggattaagttatatgagcgtatagggattttgtccttagcctgagaatgtaacaatgtctgacacttggaaagaacttactatatatttttgcaaaaatgaatgaatagtaaatgttaatgtttcttaagtctgaatagaaatgaactctattggggattttctgtgactaatggacactgacacctctactggtctgctttattttgattctggattaagtaagagtcaataatatcctaggtgcccatttaatttttaactatctagcaaaatgaaaatatgaacccctttttacaactatgactcttacagcctcctggaccttggttttggccagtgtttctcatttgtagactgactcttactttgacacataggtatcagcaacactcaggattgcaaatcttatatgggcatgtggatacagaaagccatagccagagttcctaggctggtgggtgtttctgatatttggcccataaccccattaataatttagcacttgttaggccatgtgtttggggtttgatttagggaaaaaacgtggtcacagaaacactaaggagagcaatcctccatgttggtatgtagagataaatcatagaatgttagaacattctggaggaaagctgtttgggatgcactaccaagcatcatgcagattcagtggaggttatagtaacggtcccttcatttacgcagaacatgtgttggctggctgtactacacagagagcaaaggcgggtattcacaaagacagaagtaagccatgatcttttaattaagaaaagttcctgtctcatttatttcctatttgtcccccctccacatccctttcctaaaaagggtcattgaaggcctgaagatttctagattcttgatcttttttccagaatttacctacctgttccatgtttcacttcatctggccttgaatctccactgaatggctatgtagcagttatgcactaataaacagtgcaagaattggtgttactttgcttattagtggacactatttaaagagccattaataaaaagaatatcagtaattgtcagattgatggatgagatgatttgaagccgggagacttttggcttccataagctaagaccctgccaaaggtgaggactctgaaggtaaaggtgatacaatctagacctgcaggtagatctaatacaacctcatctctgtgcccaatattggggttttctcttctgtctatagcaactgttgcccctttgcagaatttcagcagtatgctcctatcttctgctacccgccacggcgtctttaatttccaagtctctttcattgacaatacatcccagttcttttgtcaaccgtaagatctaacctgatcaggttatgaacctgatcataacctaatctttcttaggtaagtaagaacgagacagctaaacaaggttggaggcaggcaggaagcagacaggactaactggaaaaggtttcattaaaaaataaaacatttctcatcatttgaactgaacaaagtctgctaacaagtgttttgcctgctggggtttccagctgttccctcctgagcacttgggcatcaaagttatatgggcccatggtaggactgtttgctctgttgccagggcaattacagtctgacagtgctcaggtctgttcctgtatttattactattgttattacttccctgctcatggactttgggggcctcccaacacagatgcacaccctggggaatcacaaagccacaggcacatttgtagccacggcttggcaattcttggattgttatgaatttagcatattccctttatctagtaagcagaaccatagatgtttagacctactcccgcaagaaagacggtttcctgcagaaaatgtcagttttccactccaggcaaggagcagaaaggagggactgcagtatcttcattttcatctgaaaagatctacaggggccgattgaccggggcttcatgcctgacactgggcagagagacatattcattgtcaaactgctcaggtcctagacttccattattgctacagctatacataaatacatttataaacaaacatacaaataaataaatttaccctttagaacaatcagaatgctttgcattcttactgtgtgcatgtttcaaaaggcaacatatacacgtatcatcctctcttcaaatctacttacactttggtaggggacgtttgctcaaaaacagagcaaagttttagaaacaatcttttccccttaaagttaattgtattactaatccaatatagtcaacacattttttttttactgattttttaagttcaaagatttgaaaattaaccattattttttaatttacttatagactcagtatgagttttatacagcaatctcattgcttttaagacctgaattatgattttctctgcatttggtcaggcctcatttactgaactgaatataaaattgctatatggcttttggtcagatattatcttttagatcataacagcaaattctagccatgcgtaaatctgcagactctaatgtatattagcctctcttcctgtttgtgtttgttctaagtctctccttctccaaagtattcagtcaagcaaaacttgaaggaaaataataatagtattaatgaaggagagttttagtgactaaaaatgctcagaacttgaatgcctacaggagccaagcaggtaatgtaaattcagggactgagaaagtgtaaaacagtatggacttaactgcttatgttgctacacctgcttagctctttcacctttaaaacactgtgcagggacaagcaaccaaaagatgtctgtaagtatacacgtcccaaagtcctaatgcagagaagctattcttccttcagacattcaaggcaaatcctattttagtgtatgttttagcttccttaatacgcataagatcattggggattgacatttcttattcccttcaatgatcctttaaatgtccaccctggactctaaaatgacaccctgtaccaaacgctgtgctagagatgtagaaataaaggcaatttttagactggaggcaggtacatgagtcaccttcaagaattcagaccatgctttttttcccaactcctaaaacagagtcatgtacatagtaaaagctaattcaatggccattaaatgaatgaatgaacaatgggctctcacaattatttgctggagataatgatgctaacccagtccagttagcagaactagactgggttaacatcattatctgcagcaaataattatgagaaccctgtaattcttcaggaagccaaggacacctcttaaaaagacacccacgcacaaatttacatgcaataagaggagaattaccaattgccacggactctcattggtcagtgaaacccagttaaaagcctttttgctagagcaagcaaacagtccccagataaactggagatagggagctgggagatggtgctaagcacggtgaccatgctaaggtgtcatccaagtacagggctccataccaagtcactctcgtcgctctgagaatgtcgcattgcttcatctcatgttctgtgcagtttaactagtcaaatgaatcattttgtggacaatttctctattctctgctctaagatctaaagtttctttcttcgttcaacttccactttccacataaattatgtataatgggaatactaatcttttatcttacctcattcaacaacttcagttatgtagaggaataaaagctctggcttcccttgaatatcacttctgaatacttggcctttctgtgttttatccatatcaaatgaccatgtaaaattggagaaaaataaagatttcagctggaaaaagagaagcaaaactaagcaaagatgagtggcatttatatatccatgtaaatgtgcatacacacacatatctgtgatctgtgcatattctgctatgcctctgtgtgtaatattacatactgcatagggaaaaagtgtctgaaaaaattcacttttttatggggcatttactctgtgcctccatgcaaggcatgtgcactttatatctcatttaatctttatagaagcacttaagcagtagataatattttcccatttttaagaagaggacattgaacttgaagagcttatgtaactcaaaagtggtcatttggacagaaagttgggatttagatcccagagagctgactaccaaaatactccctttatgctacttaaagtagagagatcttgctggagagtgtattttggagcagtgctactcaaagtatctggtctatgagcttttgattcattggctgctgcaatgatagagggagcttgtactcactatcccaatgccaccttcattgataaaatcagctgaactaaaaacagatgcttagttacatgattgatttacattctggcttaggcttcttattttatcacaaataaaagttcataactatttcacaggcaaatgctaatctgcagaccataatttgtatacccctggacttgactattatggtcctcttacctaacaaaaactactagccattccgcatgaccagtgaagatatgcctagtggaccactctcctggcagacaccatatggaagattagggagcaacatcttcatattaaaattatttcacatttttgaaaatagttttgatttgtgtcttatccccatcatcttccaagaacactggatggacttgaatgagctgctgtggggcttggaggtctaagtaaagattaggattgatattccactgattttcactggcgtgactataccaattgctagtgcattacaagacttccacacctatgggttaatggcccctgctcatacccaccaagtgaatcccctacccactacttctctatcctattcttccccacacttcttacatgatccaccaggaccttactgagattcagaaacccaagggttaaagccaaacaaaacggaactcagctccattgctgtggccagcttctgttctaattggtcgttgtccttttcatttgagtttctcaaaatgatgtatgtaaccatggggagagcagcacctttctccttcttccctcactctgtggtcttagaaggaaagttcaaaattaggtctgagagaaaccatagagacccaggtctaaagagattactcctgctagtcaccacacgaggtagctgcaggtaggtttcagaagccaggatgtggagcttagggatcaaagggccagagaagatgagtgcaggaaacagtggtcacaacagcaaaggggagggaggcaggctgttgttgcacaatactgggcttgtgcatgtctctggtgccatattgagttttttggtggaggcatgagaaaagagagagggaatctggaaaggtagaacataatttataagaaagactgacctccagatctgcaaaagctcttggtaaacaaatccatgaagtataaagcctctgttgaaatggacaatttaatagagtcagggactatttctgtcactctggctctactgctacttaattacataactttttaaatgcagtttatgcatccgaaaaaaacagagtttggcttgatcagactctaggctacctaatgatatagtctctgattcacatttaccctctgtatgcatcctctagaaaaacatggaaatgtaatcacagagggttttgctgtctgctgtggtcattcatggtgtagggacaatttcaccaataaaagacccaaaggaaggtccagcatagaaatgaaggacatgtttgaagtctagcccacaccttcaaccctgctgtgccagtgaatatatggccttttttgcagttactaaggaaacaattgtcagtaatggattaggaaacctgggctgaaaggacacacacagaggaggctttatacggaggagcccatcagatgaaagctggcagagacaccaacatgcttagtgattgatccagtcctcagcatgaaagcattagagtccatttgttggggtcgataagtggagaagccacagagcccatccaccagccctcatgctttcttctctgctacctattagagttcacagatctgcatggtctgattgactcagttttaacttctctgttgggtacatgtcaaggcagggaatatacacacttaattcaagttcagagcctctccaaacctgtttaaaactccaaaagtcactgtctttcaactcatgctggctctttgtaaaggttctgagaatgtttggagggacaatactaaggaaatggatgtctcattgctatttcttcactagacctttttgctgggggtttacctcccctgccaagtagacacaagcctagtgaccctaaaaaagttaaggggaatctaggtgataccaggtagttcatgggaaggaaaaagtaggaccctaagaaactagataggcctaaccagctcattcctttgccttttattattgaatatttaaattaaaatattaaatttaaatttaatgatttataaaagttaattttaaatttaattttatttgtagatttaaaatcacatattacataaaataatatcttaattcagatacacttttttcaggcttacatgcattgctgaaggaaagaatgagtggcaaaagcaattaggtaatttgcggattttaaaaaaataaggaaaacacacaaagaaaatatttaaatcatgcaacctcatcgcgcatttctaaccagttaacatttttgtgcccatatagcattacaaaaatttaaagtaaaattggggtcataaagaatatagcatactatagtcaattatactttacattatgattatatccctatgacgttgccaatttgaaacacatgatgtcaatatttccacggtgtgaattcactcaagtttatttgactagtaatagactggtgcacattttggactgtctctgttgctcattttacgattatttccttaatattaatttctgaaatttgtattgttaacgccaagagtttaattaaacactattaaggctttcgaaatacacttccaaatttccttggaaagactgcagtctatcattttgccaatgatagaatgtaacagtgactgtttccagtccatttccaggagacgattatgatttggggctgagagtaagcctacgatgagaagagaatcatagtattttattgttatattaatttgcattttatatcaaagcaaattaacattttcttctctgttggaattatgtttattttgttgtttccattttagtttagtttatggtatttcaggttatttagatatattcaaattttatatatctaatcattaatattttcctttatgatttcttcctttgaaaatatacattgaaaaaccttctcctggtttggagatgataaaacattaatgtattctattcctttttatcattaaattctttgatcatttaactctttaatcaaaataaatttttttttttatatttggggtaagatttttctctcaaatattaaccaactgcttttgagtttttatctttattgtagtccttttcctgttgcctgaagggctcctttgtcaactacaaacttatttaccccaagatttttgtgctttctctattcttcctttgatctgcctgccatgttttatatcaataccgaaacatttcatcatcatcgcgtagaagagctttttcttatctgtaagggaaaaccctcattaatagtttttactttttattctgggatattcttgccatgtattcttccagaggggaatttgttttccaagtctgaaaatccccagtggtgttctgatttcctatgctttgatagactaataggaggagaatcgatattgcatggtcctgggccttgctttcccagaatttatttagatgttccttgctgtctcttggtcctaggatttatcacataacccttgggatatttattattaatttcattctcagatattttatagttctgttgctattgtgaatggaatttttattatatttaataatttattttgctggtttaaacaaagaaaattgatttttgtatatttaatttgtaacctgtctatttactcaattgttgccctatctctaataaattttgtctttcagttgatgtctttagtttgttttaggatataatcagtcttcaaatgaagataatgtgattattcctttctaatatgtatgactcattttttcttatcttattgaattgtctgggtcttgccaaataataggaaataacagtggtgaaagcaggccataattttggtgatagttttaacaaggactgtgttagtgtcaagtacgattttgacaattggttttgcatgagcatttgctgctgttattgataataataagtacttacataatatgcagtggaccaactactgatctcaatttatatattaattcactgaattatctcagcaactccatgaattagatattattatgcttattataattattatttccattacatagatgagaaaaccgaggcactaaaaagtcaaagggcttcctcaggaccctgcagttagaagtggaagcactaggactgtaaccccagcaatatgggtcttggggcctgtgtttacacacaccatgccaggctatcttctcaggtttacagagaatcctggtgggctcatatgagatgacttgtatcagacatagatgcatccatctagaagttcctgatattttcttctgttctctgccctttatcttgatatgttaggtatgttaacatctatactagcagatttcctaatgataccatcatcatgccattcttagaaaaatactctctaaatcatttatatttttatatatttatatttctgaacataaatttttttaaaattgagatatctatgtatgtatctatgtatgtatgtatgtatgtatgtatgtatgtatgtatgtatctatctatctatctgtctatctttgctgttggcttgctgccctgtttatatattagtaatgcaataatcagtttttggtattaggattatgttaatattataaaataaattatgaaactttttcttgtttatgatgtggtttgcattcaatgtttccccttctcttggtttgtcttcctgacactactacccaaaacattttgaggtgcaatactttctcttcaaaattatttatatcttgctccactgtcttaggtattagtagtatgaataaatattagactgtttaatttcagttatttatagggatcttgatccttttttctttattttctttaattatatttcaaatacttggagatcctgtttgatatgtaaactcagatattttttggaccgtaggtgagtactttcttccttctcctcatcctcctttccttccttttccttcttcttggcttctgctatgactaccatactatctgagtttgaaattccaaatggaagcatatcacttttccctaatctcttctaaaattcctatttatatgtttagctcatcattttaatctaatctgttgtgttagttttgtattgctgtaagggaatacctgagagtgagtaatttataaagaaaagaggtttatttggcttacagttctgcaggctgtaaaagcatggccacagcatctgctcagcttctggtgaggcctcagggagctttccctcatggcagaggtgaagcgggagcaggcatgtcacatggtgagaacagcaagagagagaggagcaggtgccaggcactttaaacaaccagctcttgcctgaactaacaattcactcgttcccatggggagggcaccaagccatccataagggattcacctccatgaaccaaacacctcccaccagaccccacctccaacattggggatcacatttcaacatgagatttggaggggataaatatccaattcatatcatccacctttgagatattggaaaacttcttgaagttgtcttctctgtaatatattttattttctacattgaacagtctaactcacaattttggcctttaatttagaaaatgaattttaatctcaatagtgatgtcacttctaatttcttattgtttcctttttgtgccttttaatgtagtttcaccaatgcaatatactcatttctttcagaaaatataaacaagaaatttcccagatttttcctatttctggcagtaaatctatttcacaaaaagacgtttttttggtatcttcagagtggcccccttttatctgcaatatttcttcacagatttaatgtctttcctctgtgcatgtttacagaggatgttcaatgatgctctgttttataaaaagtgattgccagaggttgttgtaagactttggggcagatactaaaccctgttcacttataacttggttttgtaacaaagacagaggcccatgcaaggtttgaggattgatttgggaccatcacacaaagccaggacctccagagatgacaactgtggtcaataaattagtaagaccgcaatctgcaaagggacaatgtgggcatatttgactttcttggccatgtctttgggtagagcagtaaaaatgggcaaagtcttcattcataatttctaaacacagccctccttcaagcagatttggaatcacaattcaaatgtacctgtagctcaaaaggcctcaagccaaaaattctctctatagtggttcctgattggtagtgtcctcaagtacttaggggagaaaaacaaaagttccaactgaagaaaagagcgctaacaccaatctacaaaaacagactttaatgttaaaaaaaaaagtttagcattttaaaaattataaaataattgagcaaacaggactacactactgacactcaacagaaaaatcaaactactgtacgatgcccagaaacactgcatatgcaggaataatcaggtatgataatataaaataaccatggttatatgtttttcagaaatggttttgagatgaatgagtttacaagtagattcaatctagttgaagaaagaattattaatatggaacaaaaatatgaaaaaaatcagaatttactacagtgaaacaaagaaatagaaaataagaaagtaaggttaagagatgtggaggacaaagggaaaatagaaaacataacatacgttgaatattatctttgatttccttgacagaggtaagggagaggcaatattcaaaaagatcatggatgacatttttctagaattattgaaaaatactaattatcttgtcaataaattctaaataaaagaaatgaaaataaatttaaatctacttcagaaaatccaagataaggagaagatcttacaaactgctaacctaaattccaccattcatttgtaggcatatataacttttaaaacattttttccaggtagcaataatttcttaaagtattctttaaaatttctgaaatatgtggatattttcttgatgagattatagagccccgtctcctggaaatgtttacattttcctggcaaactatggcaataaagtctgaaagtgtgtgtggaggggagtggggtctgaggatcatcacctctgctttcattgccaaatctttggcataaattgtgtgactgcctgctttgtaccttgactttattcaactttatttaaatcatgcgcatttttcatattctaaatggttgttataattatcattttaatagcttccttatattacatcaaatttattccattacaatttcctcagtcattcctcgcctattagacacttatggttttatttccctcaaatttggattattatatataatactgtcataatatacatttttatgcctatagcttcccttttattttggttcagtttattaggaagggttccctgaagtgacgttaccatgtcaaatgttatggagccactgccctgaaggtctcgattaatttacacttccaccaggtattttgatatgtgccagtttcagcatgagggtcagcactgagtattataagtttaaaataaaggccgggtgcggtggctcattcctgtaatctcagcactttgggaggctgaggcaggcagatcacctgaggtcaggagtttgagaccagcctggccaaggtggtgaaaccctgtctctactcaaaatacaaaaattagctgggtgtggtggcaggtatctgtaatcacagctactcgggaggctgaggcaggagaattgcttgaacccaggaggcagaggttgcagtgagctgagatcgtgccactgcactccagcctgggtgacaagagtgaaactctgacacacacacacacacacacacacacaaacacgctgtgtgtgtgtgtgtgtatatatatatatagcaaacttatatagtaagaatagtacatatatattacatatatgtaatagtctatcaatttgcagagtgtagaaggcatttttatttaaatgaaatggaacattttcccacatttccttatttttttctcttttgctcaccaattatcagtacttatgctatttagacatcttttttggacctgatgtttgtcttacagatatctaacagatactcttcttttgtggtgagttatcaagaaaagttgtttaaatcagagagggttgtactggttagctttgcttactaatactgtgcagacatagggacctatattttctagcagcattggcatcagaatactagtgtgatagacactgttggcttgcctgacactcatttctaaccctcttctctcttacctgtctcttttaaggagggtgaacaggctgaaacattgagtgaccagcgcatagtaaagctggaggtggttttattataaagcctggccaataaaatataagcaagagtgtgctggtgccgttgtgccacattttctctttctttttcctcagatgatgatgtggttgctggagccatagcaaccaccttgcaatcagatttaaacaaacaaacaaacaaacaggagaatggcagatagtgtggcctttattttattacattgctgaaataatgccatgaaccttctaccttttcctcaaatttatttttgtgcaaaataaaacctcgtttaagtcactataatcagactttgtgttactgtctgtggaaaaaatttctaattaagacatctgagctgggtgagaagggaattggatcttcattttatttatactcacttttaaacaaatccggagccagttttattcataaactttctactgtgaacccgtgataactgaccaaagtggaggtcaaaatttctaaattttatttacctgtttcccagtttatatccagagatatgaataagtctcctggagccaaaataaaatctgttttatttttaatgctcacaacatttgacaatgggagaacaagatttaaaggcactcacatacccaaacccagagaagtcaagttctacttgacagttacaatatgtatctgagagataaaaatccatccatgcctctccacgtccactcatttagagtcgctatttacccatttatcacatactgaggatatgacatttgacaggtatgtgctccatgccagagatgtaaaggaagaaacatactcctcagtctttgcctttgaaaaattctcttccacaccagtgatggggtgtgagaggaggtcatctacataaacaaatatatttagcccaggagttcaaggctgcagtgggctgtgatagcgccactgtactccagcttgggtgacagagcaagaccctttttctaaaacaaaacaaaaacaactctcaaatatgttttatactgtgtgagagtaaagagaaaaaaacagagtagtaaagagagattaatatcaaagggcaaaatggaatataagggccttgcccaagtctccacagccaatgaagtggtacaagttcctttaatcaaggtcttctggactacttgttacaatgacaactatgacctgaaatatgtggaccaacatctggggcatcaaattttttttacattataaaatactatcattttagctgttattgtatagaagttgactggtatgaaggaactctccctaacctaccagtatggcatatactgtgaggtttattttcctgaatgactccttcttttaacctctacagagcacctgttatgtgtctgctggaggctggggttgcaaatgtgtatgcgagtgctcctgcccccgagggccagagtcttactctcattccccttctcgcctcccctttgccacctgtgaggtggctgactgagcaggcaggtgtgaccttcacttccaatcaagccagccattctagaattgtataaaagtaacctggaaaaggggttggggaaagaatcagacctcggagctttagaaaagagactcagatttctctttctttagaaagtgatcttttctattgacttaagaaaaaaacaacttgttcaacatctgtctttcccttctgactgctgttgcttaaggaggaactgacttcccttaactctgaagtaatgtctcctttctttaggaaaacaggtgtcaaaacatgcagcaaatcagattttcaaacagctgaaataaacttgaggattttctacctttttaatgcttttagccaggaattcttttgtgaggcttatgatttcccagtttggaattttgtttctccttgaggtgcttatgagcaatccttctgcattcttattgtcccattcctgtcctccataataaatcattattatttggatgtgaaaatctattcataaaaaatgattcattattattttttatttaggtcaaatgtactttataaacaggaaggcctcaggaccacactgaattccgttgtattaaacgtctttataggaagagagaaagataaattgagctaattttgatcaatattatgactgtgaaatattccttatcaccagatgcttaggtatgaaggggagaattatgattccattttacagatgagaaaatcaaggcaaaaagagttcgctgagcccaagaccacacatttagaaactagtgaaaccagattcacacttaattctgatctaacttcaaaaaccacgcactttctagctcaccacaatggagtctcttctagtcgctatacagctttttatgttgagtagtcaagactgaatttacttattagcctctggtacttactagatgctaggccttggataagttacttgtattcataagtctgcatctccttatctgtagaatggagaaaagaacaatctctacctcacagggctttggtaaggatccgctgagttaatgcaaatcaaagagcttagaagggtatttggcatgcagtaagtgatcaattaagtttggtcaattgttattattatctgtttcttcatgaattatactatagagtacatgtcatgattttgctttcatgcatatatgagtacagctgaatagggggttctaaatgaatactggttttttaaagtttcagtgttcagtatttatatatgaaatatttcccctacttttctccattggccgataaattcagaggaaggaaaagttatctcttagtaagattctttatgaacttctgtttcagaagtgaaaaaaaaccctttttaaaaatacagataaaagcgttgctgctttgaccatggtgtgggaagggtacagattcctggatctccatatatccccctttccctttataacccctaccagctcattattgtcatgggggtacttctggggagccctggatgtcgacatcacacagactgagaaccaccactccacaatgcacacaacagaatgtaatggacagtgactgacaaatacaattaattctcactgtctgaaaaatgcctgtgtgtagaagtccttcttcctaatttcaaagtgtcaccactcagctcccattatacgttgccacagttaatgctttgtttaactggcagggtctacagtttggtaccagagaactggaggagatgggagccatgttctgtttgggcctcctcatcctggagctcaaatctgccagctgcagccatcagctcctggctcaagctgcaactctgctgagtgctgaggaggacgctctggaccagcacctccaacggtaagatgctcccaagggctcagagaaatttggaccttggtggttccattgctcaatatctcagtaatgaaagtcgagtggacctaggggtctttacacagagaaaatatggaagaattcccaagtaaaggtaggtacactatctcgtttcctactgatgaaaaagaggatgctgcctgtttgtacacatatatgcaaatataaaactatatgtatttatacatatttctaggtaacacatttatgataagatgtggcttggtgacacacacacaggatatctacatacacttatatttaccagttatgtgtttatatgtatacagataacatttttgagccattactcaacaaaaaacaatggcaatctcattgacaatatctaggcacctggagacaagaaatgttttactcttcccattctcaaacatcattgttccttcttggaagatgaagggaaccacctgaagatgattaatactttggctcagagaaccggactcccagccataggagggaaaggctagatttctgagaatcgtggagattattaatgagccaagtgagggagaaccattatccaaatgagccgttttgatgttctttcctgttgagaaatattttagacttgaccaaaacaaattcagtgggcaagaggggaagaaataatgggcatgtgagaggagagaggatggaggggagtccaagaagccaaaagcggctaagtcattgcccacactttgagtgtcagaatggatggagaaattgagttgttggggaagtgtctcctggtaaatgaggaggcatctggtcgtgcacttcacgtccaaaggcagagagaaagccattcatcctggggccatcttattttgagctaattttcttgaattttcctcctgttcctgttaggtggctgttgcagtgtgacatactgaatggccagtgaaacctagaaagatctagcagtatgccttaatactgctttggaaggccgtggtttttctgagacttgattacctaaatgcagtaattaacttgctcaccacactgggctatagatcatagactatagaaacttaagtaagtgcagggctctttccatagagctgccgttgctgatttattttgacatcacaaccacttctgcctgcccctggtcccttcaacacccctcagtgtctgaaggcttcgtgtgtttggtatctttgtggtgttttcagactctccctctgacagcaagcgcttccacctgccagcatatatatttcaacttgtcttttcatcttttcctttactaagctatcttgggtgtaggcatgcctggattttctttccttctttctctttttccccctctctcctctgctgctcattgagggaagattgagcagaactggcattgcttgctttcgtcaaattgattgtgcccgtctgtttgatccaattcagtgaggattagttgcctgcaaactggaacaaaaagaaatctatcaaagaaatgccttttctaattcaagtttaaagaatttgatgtcaggcttcaaatacaatggctgctatataggttattataaggagatagtattatttgcctccacccttccacaccatttcacacaattattcatttttcaattgcatcctgaccaaggggattgaagctagaggtcctcccatgacctctgacctttcctaggctggtgcagctcccagtctaggaaagatacctgaacacaggatgtgattaatatgtctactttgaatatatttgaattaagtttggcaggcatggagtttggtgtagatcagcaggagggaaactacctatttcacccagacatttgtatggtaatatattttcctattcgttatgatgcagttgaccacacggattgcgattcttgcccaaaggacctgaaaactgcatggttgagagggagatcaccgtgagcatttcttgaccccaaaaatgttccagccaataagcttatggtcacaaaaagatgacagagagaaaaatttataaaatctactggtttgaaaccatcaacaggctttttgagaaccatttgattagtttctgaagaataaagttaaatcctgagatataataatcagcagagtgaatcctagaacttttgttagtatcaggattcttattgtaatacaaagagtgtaaccaatgtttgtcaacacaaatctatgtatgttttaaagaggagacctctaccaccctcctctcctcctgcctctttctttgacataacagggtttccagcatcctacaagaagatttgtattgttgttgcgtggaaggaattgtgaataacattgtgggtgagggggctcttctccaaaggtctgccctaaagaactacaagaatggctgggtgcggtggctcatgcctgtaatctcagcactttgggaggctgaggcgggtggatcacgaggtcaggagttcaagaccagcctgaccaacatggtaaaaccccgtcttgaacctgggaggcggaggttgcagtgagccaagatcatggcactgcactccagcctgggcgacagagggagactctgtctcaaacaaacaacaacaaaaaaaatgcaaggatgtggtactgcatcctctcctaggcccacagacagcattaactccttgggagtgatcagccaggaagacaaagtgtggctgcacactgtggacatcatgttttctgacaataggtttcatgcttcatttaccataaaaacaattagagtgtactcaatatccacagagcaactcaacatttttcaagagcagaggaagagcagagatagcggatgtttgcctggtggctgacgctgaaaatgaagtacatgcatgctttgtttttggtttccttttgcagtcctcttcttcccagttgctcatttcagaaatgtctgcatactcacgaaagcatcttttgatctttcctctcctcttcctttctccttcctctcaatcttatccctggaaataattgtgtgtgcactgcaggaatgctaagctgcttcttcaggaggagccgtttatccattgtgacaggtcttttgcaaagtcacttaagttttgccgagtcagccactgttcgtctcgatttgtatccctccactgcctcttgctcttctcagccgagccccccacctccatttgtccctcacttaataacaagagaaagctaaagctcagagcttcagagctgtgcctcagcaatggctcaacacctcccgtgttctccgaaattatagtcctgttgctttagcctgggctcaccttagtatctacataaactaggtttgtttgacggacaacactaaaagaataaaaattctacatagatattagaaaaaaaagtttaataattaaaaaggtgcttgattttcatttgtaaaagtataattttgttcttttgaatgagaaaatgaaattaggaagacagacaaaagcgcccctatccctgtctcagcatccagataactactgtcagcattatggcgaaatatcctaaattatttttctgtttttaacttaatttattgttttaaattgacagataaaattgtatgtgtttattgtgtaccatatgatgccttgcagcccatatacattgtggaatggctaagtctagtaattaacctatgtatcaccccacaaagttatttttgtggtgggaacatttaacatccactcttctatcatttctcaagaatgttatatattgtcattaactatattcaccatgctggcaataaattatttgaacttattcctaggttatattttttacctatggataaatagacatacagtactctcaaaaacaatgtgctataagttctccttttttgcagctttataaacacttgttcctattttaaaacttttgccatttttaggagaaaatggggtgctgttttaatttagaatttgatgttttctgatgcagataaaaatccttctatatcatgaggagtattttttataaatttcctaatcacgtctttgtgcattattctgttaaccatccctttttttaaaaaagttatatttacatttaattttaatttctgtgttaaaggtactcaacttctgtttgtcttgtatgctgcaaatattttccccaaattgtcatttacctttcacattttctatatggtttattgacattgaatatttttgctttcaagtaattatgtttatcaattcttttctttgcttctcttaccttggataaacctgtctacctcggtttaataacagataaattcacacccactgtttatctatctgttattgaactgaggtaggcaggtagttttatagtgagtatatttacatattataatttattttccatttttactattgaatcattttgtatttttaagtaatccaccttttatcacggattagtaatgccggtttattatatagtatatacacatgcatataactgggtatattttttggatttgtattctgttccattagtctgcctgccaagagcacgtagcttttaatactgtagctttgtaatctaaatgtatgatgttgcaaacaccacctcattagtatttgtttaaaaatgtgttttgctgcattctcttctttattttcactgatgcactctataatgagttgttagctgccaaaacctaacccactgggattttaactcaggtaatattaaattatagatatttttggtctattgagtgctcgtctatgttacttttataaaatctgatatttttatttactgattcagatctgctttgatgttcatcagtaaagtattgtagggattctgttcgtatcctttttatgtagttcctgaatatatcatcataaacttttaatctcaatatttaaaaaagttttgttcatctaaaaaatgtgtatttttcactacattgcttctaagtgcttgttttagttatataggaaatttctgggttatttatatatttatttgtaacttcagtgaactctctagttatacctaaaagtatttccagggatttttctgtttttctggatagaaaacagtatcatttataatttttgaccatcagctttgcttacttctttttcttatcttatgatctgggctagagttttgagactaatgtttaaggctgaggcatttatgagcatcctcaccataaacctaacttcaaaatgagaatgactctaagcatttaagaattaagtgaaatggctcttggtttgatattaatatttgatatcttctccattattactatattttcttagcttattaatttaacaaagtccagattagatgattaattttatcaaaagattctttagtatctagaaaaataactatttacttgaattaataaaatcttatagattttctaatattcagctatctttacatttctaaggaaaatgtatctggctgtgatctgaaatattattttaatgtagagattgatattacctactgtgaattgaggagttttgtgcctatatttgtgagtgagtgaagtctgtgcttggtttctattgttctatgacctggaacactttaaatttcctaggtaggatacatctgcaccttgaacatgtacatactgcctgtaaaatcatctgtgttctatttatttgaaacaaaaatattatttttccaatgttaattttcccaaataagaattatctatggcatttaaattgtcttataatcatattcagatcattttaaaattcaactttgtgtttaatgacttgcattgctcatctctacccattgtatgcaatcatgtcctcattcttttttctcaatgttgattcatcttacatttttcagagagcaccttaaaagtagcttttcttttttaaaatgtaaatcaatggagttttttgcatattaatacatatgtgaatatccttctcttccctttacctaggaattctactttccctgcctagagattttatgggtaacacattaaaacaatgtagacgtggccaaatttactctggtatgtaatcttatggtagccagcctaatttttctttctttgtatgcaccctgttttttctttttcttttcttttttctttctttctttcttttcttttttttttttttttttttgagatgggggtctctctgtcacctaggctggagtgcagtggggcaatcttggctcactacaacctctgcctcctgggtacaagggattatcctgccttagtctcttgagtagctgggattacaggtgcccaccatcatgcgtggctaatttttatatttttagtagagacaggttttcaccatgttggccaggttggttttgaactcctgacctcaagtgatccacccacctcagcctcccaaagtgctgggattacaggcgtgagccactgcacctggccgcaccctgtcttttctaccttcatagttgtagtagtttctctgtgttccctaaaacaaaaattatttctctactacatcaaaaatatttctttctttcctcacttctttcttttctcttgtgtgtgtggtttagttcctttaattgattttgaatatgaacattctattctcttgaaacatgtctcaattataaaggatcagtgatgccaccccacgtcttcatttatcttcctctgaagtgtttgttatctgttttctcacctctgtatctgttatctcttcttctttaatcctttttacctccttgccccaattcatcaaattctggaagtatgtctcaagtttgccctcacacattcaattttctgcagcatggactctctgctctttgctgataacatattttaattttggtgactttacatttaggtttcattgcacctattcctcatctttcatgagtttccttttattcatgtttgtactattgccagctcactttccatttggatcagttatcttttcatttatcgtcccatagattcctttttgaaaaacaactttccagatacctttatacagcctcctgtgtcctgtggctagtcattcccctgaagtgcaccactgccaagcttctggaaaggcattggcctccttgtacttttgcaggatgtttcaccacctctaggttgtgcttcttacctgtttctgctcttccaacttcttttcctcattttcttttggtctattcattttgaatcatgagagctctatcatgacttacaattagtcaataatcaagagtttatatgttctttaagcccttttatggtctagctggatgtagagaggtcctcttgttttaatagaaagtaacgtgatttaggtggtgctttctcttcaagaattcatggtattttggcttttacctgagagtacaaagttgggtgattgtgttggagaggttaaggagagcaggcatggagaagtgaatgaagatggaaagtgccctactaatgtctatgggccaaaatgggaaatttgggattggagacaatggtttccataaagatcccattacagtaaagcgaaggatggagtcttagtagaatcttcagtttcaagttaactttctgtttccatcaattccaaattaatgctacgtgactattctggtaatagctctctttaattatctgctgttgtcttaattctattcagattttaaaaattagcgcatagtatgaaatatctgagactattcttagcttctttctatagttgcaggcaaataaatgctacatgttgggaaatgttggaatggaactccgcctgggaattattatagattatgagtaccatatcctgctttaaaacattaaatggctccctaactggtcaagggaaatgaactgattggccagaagaagtgctaattttaggctgggaaaacaatagcaaaaaacaaacaaacaaaaaccttgtttcattagctgttaaaagcaaaatcaaatatttttggtatgattttatgctgattcttctataatagataaattaaaatagtgaaaacccagtgttcacatttctgtgaagaaagaggtttaataatatcatgaagctattggtaaattgatttacttttctctggagagcaatttggcagtttgtaaaaaggcccataaaaatctctcatttgatcctctgtttacagcttacagaatattactcaagacaataaacataacagaaaagaatatttattatgcacatatttatataaatagtacttatttctccacaaaattttaaacaactcaaattcttagcagtaaaaaaagaacattattgattaattttctgaattactatactaccatgaaaataataagtatgtcaatttatatataagataataataaagcaaacatttattagggccttaccatgaactagatgctgtgctaagcattttataaatattatctctcttaatcctataaataatcccatgtagtagatgcttccattaacattccctttttaccaacaaggaaattaagttttatagaggctaataagtttgccaaatgtcatgactatatttaagggactgcactggcatttgaatctacttttgcctaactccatggctcaagttcttatcctttgttatatttagccttttgaataatagatgaaaagcaaagcagagtaattaatggtgtacacatgctgattacgagttcagcaacacaaaaaactgacagatgggggggcattaaatgtataatctaaatttaatttagttttattaatttctctttatagttccttaacgtatgtattgggtacatgtatatctgtgtgtgtttctgggtaagttttaaaactcaaacgacttgggttcattttggaccataaatatcccttgattgttttaatactattcagggaagattaatgtataccattataggttgaatgtgttgtaacccatggtgaattgaaaagagaaaaagattgcacatgccaaggagtgaaagtacattttcttcatactgcatttgctgcttccaaaatgttaccacctaataacaaccatgaaagttaacctaaaataatgcctattttacaagtgactccatgggagtccagggaatctaagtgacttgctaggtgtagttaagtgatttacacattgccagtcaacatgggggatctcattcacctctgcctcaggctcaaccaaatgaacggcaggtctcttgcctatgaaactataaatacctgaaaatagaataggctaccagcccctggaaaaggatttcaatcaagaaactcactcttactactctctatagcaactgcagcccttcccagcccttgtcttttgttgtcaattctaaaaatggaaggcaaataaaacttttgaagttttcccaaacaggagcagttgttgtcatttaagaaggcttcaaatagcctggcatgggtggtctaagttaactcaataacttttcattaattttacatcattaccgctttctcttctttctatctaattcttatttctttttattaagtaccctgtgacacctatggctcttaccgaagagctagtcctttaggtcaaagccattttactggtgagagcaaatctaccagatgtgctagaggaaaacaaaagtgtaaatacaatagtgaaggcaaaggagagaagggatggagggaaggaaagagggagggaggctaatgaacaggagaagaaatcaaggcatttgaactaacagatcgttatggggataaaaagcatcttagaatgtttacattttttggtttgaaagatcatgagcttagattactgatttagaagaaagatggtgccttttaaagtttctgtgaacatttccacatttttacctgatttctttatctttgccaattgccaagttgccccctctcaggaaggaaggaagtaaagaaccctggctacattctactgtacccaagatgaaatagtctatcatggcttttgctgtcctgtaaatttccatgaagtcctcactttagttagtacctagcatagttctctctttttttttttcttttttctcttctatttctttttgtttttgagacaggatctcactatgttgcccaggctggtctcaaactcctgggctcaagcagtcctcttgccttggcctcccaaagtgctgggattacagatgtgagccaccacacctgacccgtagcatagtttagatcacagacataaggcttaaattcaaggaagttcaattctgattcaaagtatttctgggatgacaagctctgtgaatctatggcgttgtcttaacttgtttactctcagattttttggctttaacattagggaatctcctttcggatctaatatcctgcatttactctcaaaggtacagctactgacaccctcacattctaacatcagtagtagagttgcaaccctgaattcaagatacaaaaggcaaagcagttgaattatgctaagtggcaaacagcttgtatttgactgaataaaaattaaattttatttttatgttgactggatagatgataaagaaacagaagccttactagtgcatgggtaacagaaaggagttgtaaacaagcaatgagaaaaagatgggaacaaagaggtatgtttagaagtagatatcaagatgtgtggaaaatatcaaaccaacatctagcatccaaagtagaatccgatacaagacgaccctttacaaggggcttaaatgttcttaccaggaatgtcaataggtactattttctgtttctggacatggacacctcaggagaaagaagtgattacctctgcttggtccttttagtttctttagacagatttgtccaattcagacctcaagtatgttctagtaagccagaaaaatatcttcggtcatgtgatagctcatcatagacttactgattctatttgtggtgagagatgagcctattggaaaacgaagataacttagcataagccaatattgtttcagtacaataggaatggaaactaaattagagtcaataagtttatgatgacttagcattcatcattttattatgtggctttgaatcagaaaagctgactagctccctgtgctttgccagtgagtaataaaataagtagaaggaagagacgataatgatatagaataccatgtgcctggaagtgtgataaagatttgataggcattatcttaaagcaagtttagaaagtcattattattattactattatgattaatactattttatagataaataaaaggaggtttatgatgctaaatgtttgataaaagccaaatcagtattatatgactgatcagtgattcaaatgttggtcactgaatcaaagctttttctcttttatttctgaaacatattgcaaatgattctgaaaatatattcataaaacagtttccaggatgaagtggaaaaattagtccataaaatgtgatctatataaatcactgttctttaccgaagagctgacttcctgtaatttcagtacaaagatcgtaacatcctccactatagggaaatatatgtgaaagtaagtcccaatgatctaaacttttcacccactagatgttccaggtcaggaagcaaaactagttagcctgcctttgttgttgttcttgatctttatgtatttaattacttgtggtcaacctagaaaaagtgaaagaaacttctcctccccactctcagcaaaggacatgcaatgattttttaggtctacatgatattggctattgaatgtttgctttttaaaggattgatctagtttttttaaagaaggcctggagagtttgaattgactccatctcctatcagtgaagtgctgaggacctagaagtgatttgcattccagtcttagctagtttttaacctctcacatgttagtgtgtgaagaaatagacaccagggaatttggtatccccatcagaaaaataggagttaatggcactactgataatagtaactgatgtttattgactgcttagcatattctaagtttttttttttttttttttgagatgaagtcttgccctgtcactggagtgcaatggcatgatctcggctcactgcaacctctgcctcctgggttcaagtgattctcctgcctcagcctcccgagtagctgagattacaggtgtgtgctaccacgcccagctaattttttgtatctttagtagatacaaggtttcaccatgttggccaggctggtcttgaactcctaacctcgtgatctgcctgccttggcctcccaaagtgctgggattacaggcatgagccaccatgcctggcctctaagtttttattcatatgaatttttatcatctctcacaacaaatagtcatgagatacataatataattatacatatcccattggacagagatgaaactgaggcacagagagcttaaataacttgcctaagcccacacagctagtttaaataacttgcctaagcccacacagctagtaagtgatgaagctgggttttgaactctggcagttagactctaagaccagaatgtttaaccactactcccatttgaacagtggatgtggttttgtaaaatcattcatctctggtttctaacttatccttgcaccggtcagggttttgtcaggaaaacaagctgctctatgaattccagatatcaatggcaaaaaaaagggaattagaggtttattaaggcattgaaaaggctatatatggaaacaaaggcaagaactctgtggccagtttaccttcaatagaaaagttggccattttcaagagcacacctagaagctgctgtgagcctcaagaacttctaagacactcttgtcaggcacctctgtctgcaaagtcggctggagaacttctgaagtaactgccctcacctgtttctgtagccaacaaccaagaagaaggtgtctggctgaggcttgcctgaaagctaattagaccctcatgtctgctgcttgcccatccatctgacacaaatgccccctacccaagaacaatggcctcttctcttctgcttccaaatccaacaaatagattgacagaatctaacctgaaaccttggagaatcagagtgaaaggataggatgattatatggctgaatactatgtaatattttaatatagtcatgagtgatttcaaaaatcatggcctgtgaatagacaaatctacagcttcaaagcagaagtatgagtgccataagagtaaagcataggctaagttagttccacaagttgctatggagtagattgatgggaattcttaaatctgcacgtttttgttgagtttccaaagtgtacataatgattacaataattttaatttatataattcttcactatgttcaggtgtttctatttatagcccctcgatgagtgtcctcagatatacactgaaatattgagagtgtgagagacccatacacactggcagccaggtcagtacaatcacctctcagcatttgtaaatcatatcccaggcacagttcccctatatccagtaaaatagttgttactaattccatcagcaacacagagattttgtcttccccaagaccctaacttttgttagcagcagaaatgagaacagggcatgaaatgagaacagagtatgaaacttccttaaaaagttggaatttataaaactaatgccaggagaaacaacaagcgcatgtcgttgtttcatgtatgaatgcagctaaaggggaaggcacattgcttggtgctgcaggggattgatgcttgaggagggaggtcctctctgacccttggatgctgctttcttcacaacataaagatgatatttagactgagaaagaggaggaggagaagggtggggaggacaagggaggagaaagaagggaaggaggagactagaagaaacttgccaagaaggaacagaggtcaaggtgagagagggaactctgaatgaattcagggttttcaaactgtctgaattaaaatgcaattctgaaatcatatgcaaattaagttatctaactcttttccaaggtatttgaggaggcttatttgcaaactgaagttgagcaaatattgttttactgtccaaaactgagaaagtggtatagtctcccgaatatacgcaagtgagtgtgatgcagatgtcaggagggcatgggatggattatcaagggaggtttattaggttcttagaaaatgaatcaaacattactcaaactaccaaatatttccctatgaagtgaaatgttcaaacaaacctgattttattatagctttaacgaggcgggcacaattgatacataataaactgcacatatttgaaatactaattggatgattttggcatatctatatatctatatatatgcataaaactatcaccacaatcacagttattcccatcatcacaccaaatatcaagttcctttgtaattcattcgtcactctactccagtatccccagacaacaactgacttgctttctgtccctaaatattagcctgcatttttagaattttatgtcaatggaatcatatggtatgtactcattttccatttagttttttacactcagcataatacttttgcgaattactcgtgttctaatcctatttcattttacttttatatggtaaatggtcagtggatcaaagaaagcagaatttgtttacctggatgtcgaccagatattctgtttctctaacagcctgagacgcatcagttctaacttaaaatttgtcactagttgttcctctgtctggcatgcattttctacagatggttgcatagctggctcctctttgacattcaagtctcagcttaaatgtcataatctcagcttaaatttcaccatctcagcaagacttttcatgaccacattgcctaaagtagcatttctagccactcctactgtaaggcctctaatttagtattatctgtctcctccagctagaatgtataatccatgggagaaggaattttatctgtcttatttaaagctgaatccctagcacctagaataatgcctgatgcataggaagtaatcaataaatataataaatgaacaaatctttgtcaagcctctcatcctgtatttatgggaagatatgaagacttacgggctaaataacagtataattccatgcaattgttgttcattgatggaatatattcaaaatacgctgattaatggatattaattaaccttgatggggatttacacccatggcattacctcaaattctgtcctattagagaacttttatgtattaaaaaaaattagctgtaactatagaaacgattgtcccttcctgtataatgtgatactacaacacattaggataatataattgatatttaaaaaaatctttacagattgaaatgatggatgatactaaaaagataaaagtggataaggataaattctgctcaaagtgttcctagccaagagcatgccaccttggaagagtacacggttctctatatgggaattgtaattggcagtgagcttaaggctctgtgtgctaaacctgcaaaagctcttattgcaactagtaactttggtagaaacataatgtctagaattagatagggaatggtttctgttttgctgtggtcaacacaaaacctagaatattatggttcatttctgagccacagaaatggaaatgggttcagtggattgactgcataatggtaagtaaagagtgatacatacaaggaatgttataagaaataggtagtgttcttttgttagctgtcttcaaatagctctgtaatgaaattaaagtcttgcttatagcaaggaactaagatttattaatctctgatactacaaagacctgtctgatgatcacagatgccccaagatagaatgaactcttactgacttgaggaccatacagtgtttggaaagacttaaaagtatgaatttatacttggaattgacagcatagggagtttgtaccaactctgaaatacaaatgaaaacatgtcatcttaataaagaaatccattcgttttcatttaattcatttggggtgagatttagtccattcacctttttaaacaggcaaaaacgctgaattcttccctaaattccttattaacatgggtaatccactgcagaggtaggtttgaaaagtggcaaggaactgggatttgtttgaaaatttatctcgaatcattagggtgacaaaggagagtaggtttttatttgtttaaggcacagaagagtagtgtgtggtagggtgttggaaggtgatgctgaaggcactgaattatggggatcttagtcaccatagaaaattatgcttcattcctcaatttctgtttggttgggtggttttgtgtgggtgcttgctgagagggtactgtccaatagcatgggtgctgaattgttagtctcttgaagggaagttttctcagcaatctcattagtagaatgaaactgcaggtgacaagataagcttgtctaatttatttatttatgaattctattgttcataattgtattattaatcagggaaatgtattagctattgatgtatttttcttttatgtggacatttattttaaattgtaagaggaacaaaagatattaattcatattaagtagtaggttgcatttttttttcctagacaattttctctattaagaagtggagacaaaggaagaacaaagacatatttgttacgtgatatggaagcaaaattgtttctaaataatactgttgtgtggtgtattcctggaggtactgacagctccttataaggcaaatgaacattttggctaaagtttgcaagcaaaacacaaggctaattataaaatattcttttgtctcttagcaaactgcagggggcaagagcgagcttgtgtaagcactgagagcttggatttccctgggtgctatcttctcacatgtgtttttaaatcttccaacttgtgattattatttttcagtactgaattagtgaatcattttacatagtgccattatgtaaaataaaatgatactttgtttctctgcattggccaattactgggaggggaaaattggactcctgaaaggcacatgtgtgtgtagtttggcagattacaggaaagccttgtaaaatgctcccagatgtttgatgcatgagagggaaaatgccaggaacaaggatcaaattgaggtgggtttcagacattataaaatctgttgatgtaaaaactaagaaaacaaataagatcataggcatgaaatccttctggaaggtcaataatgataaagttttactatattaaaccgatttgctccttttcttttcccatctgcctgaggctgttataaaaaaatattaaggaacattattgctaatccataataaatggtacattaactatgatccaacttatcttttctacacaagggccacgggactgcatgtggataaaatctggactggatttatttttttaggggcctgatcccatgtccaatcattaacctttaaggtggttcttaaaaataattttattattaagaagttgaatcatcataattatagtatccctctgacttcaaagagcaatttgaggcttgtccctctcttaatatgaggtttcttaagctcgacaacactgctggatgaggtaagggttgtaaaactgacctcctttggaatggtgtgaacccgggaggcggagcttgcagtgagctgacattgcaccactgcactccagcctgggtgacacagcaagactccatctcaaaaacaaaaaacaaaaaacaaaaaaaccaaaaaagctgacctcctttgagtgccagaattgttctcgaatcagtccacatcctagcatcaagcagatggcacatggcaaaggcgtaattgaggaaacttcaatgaaggaactctttacaaagcaagatcagggaagcaataaagaaaaggtgaagcaccttgggaaaagcagaagtgggaagttagtatcacccttagtgaggaagagggtggaactggcgaagaattgccctcacctatgaaagctgggggctgtagaaggactacccaccaggaactgcagccttaggtcacgtagccactgccaaacaatggcttcgcaaggagggaggttgaggaataaataccacatctctttcacttgctaacttcttactaacttactaaattcttctttcaaatttttttttatttccattgattttggagggaacaggtagtattggttatatgagtaagttcttcagtggtgatttgtgagactttggtgcacccatcacctgagcagtatacacggaatccaatttgtagtcttctatccctcatccccctcacaccatttctcctgattccccaaagaccactgtgtcattcttatgcctttgcatcttcatagctgagcttccacttatgagtgagaacatacaatgtttggttttccattcctgagttacttcacttagaataataatctccagttccatctaggttgctgtgaatgccattaatttgttcctttttatggctgagtagtattccattccatatagatatatcacaatttcttcatcctcttgttgattgataggcttttgagctaattccatatttttgcaattgagaattgtgctgctatagacaggcatgtgcaagtatctttttcgtataatgacttcttttctctgggtagatacccagtagtgtgattgctggatcaaatggaagttccacttttagttctttaaggaacctccacactgttttccatagtcgttgtactagtttatattcccatcagaagtgtaaaagtattctcttttcactgcatccacaccgacatctatttttttttaattacagccactcttgcaggagtaaagtggtatcacatggcagtttttatttgcatttccctgatcattagtgatgctaagcattttttcatatgtttgttggcaatttgtatatcttcttgtgagaaatgtctattcatatccttagcccacttttttgatgggattgttaatttttttcttgctaattttttgagttccttgtagattctggatattagtcctttgttggatgtatagattgtgaagatattctcccattctgtgtgctctctgtttactctgttccttttgctgtgcagaagctttttaattaagtcccacctatttatctttgtttttgttgcatttgcttttttggggagttcttggtcataaagcctttgcctaagccaatgcctagagggtcttttccaatgttatcttctagaacttttatagtttcaggtcttagatttaagtccttgatccatcttgagttgatttttgtataaggtgagagatgacaatccagtttcattcccctacctgtggcttgccaattatccagcaccatttgttgactagggtgtcctttccccactttatgtttttatttgctttgttgaaggtcagtttgctgtaagtatttgggcttatatatggattctctattctgttccattggtctatgtacctatttttatgccagcaccatgatattttggtgactatggccttatagtatagtttgaagtcaggtaatgtgatgcttccagatgtgttctttttgcttagtcttgctttggctatgcaggctcttttttggttccatatgagttttaggattgttttttctagttctgtgaagaatgatgggaatattttggtgggaattgcattgaatttgtagcttgcttttggcaatatgatcattttcacaatattgattttacccctccaggagcatgggatgtgtttccatttgtttgtgtcttctatgttttctttcagcagtgttttggagttttccttgtagcagtctttcacctccttggttagatatattcctaagtatttaattttttttgcagctaacgtaaagggtgttgagttattgatttgattctcagcttggtccttgttggtgtatagcagagctactgatttgtgtacattaattttgtatcctgaaactttgctgaactcgtatattagttctaggagctttttgatggagtctttagggttttgtaggtatacgatcacatcatcagcaaacagcaatagtttgactttttctttactgatttggatgccatttatttctttctcttgtctgattgctctgactaggactcccagttctgtgttgaatagaagtggtgagagtggtaattcttgtcttttccagttctcaaagggaacatgttcaacttttccccattcagtattatgttggctgtgggtttatgtagatggcttttattacattaaggtatgtcccttgtatgccaatttcgctgaaggttttagtcataaagcgatgctggattttgtcaaatactttttctgcatctattgagatgatcatgtgatttttgttttgaattctgtttatatggtgtatcacatttattgctttgcatatattaaaccattcctgcatccttgatatgaaacccactcaatcatggtggattatctttttaatatgctgttggattcggttagctagtattttgttaagaatttttgcatctgtgttcatcagggatattggtctgtagttttctttttttgttatgtcttttcccggtttgggcattagggtgatgctggcttctttgatgatttagggaggatttcctctttctctatgttgtggaatagtgtcaataggattggtactaattattctttgaatgtccaatagaattcagctgtgaatccatgtggtcctagaatttttttgttggtaattttttgtattaccatttcaatcttgctgcttgttattggtctgttcagggtttctaattcttcctgatttaaactgggagggttgtatatctccaagaatttatccatctcctctaggttttttagtttatgtgcacaaaggtgttcgtagtagccctgaatgatcttttgtatttctgtggtgtcagttgtaatatctcccatttcgtttctaattgagttcacttggattttctctcttcttttcttggttgatcttgctaatggtctatcaattttatgtatcttttcaaagaaccagctttttgtttcatttatttttgtattgtatttttttgtttcaattcatttagttctgctctggtcttggttatttcttttcttctgctgggtttgggtttggtttgttcttgtttctctagttccttgaggcatgaccttagattgcctatttgtgctttcttagactttttgatgtaggcatttaagattatgaatgttcctcttagcaccatctttgctgtatctcagaggttttaatgggttgtgtcactattattgttcagttcaaataactttttaatttccatcttgatttcattattgacccaatgatcattcttgagcaggttatttaattttcatgtatttgcatggttatgaaggttccttttggagttgatttccaatttgattccactgttgtctgacaaagtacttgatataatttagattttcttaaatttattgagacttgttttgtggcctatcttggagaaatttccatgtgctcatgagtagaatgcatattctgtggttattggttagaatgttctgtaaacatctatcaggttcatttgttttagggtatagtttaaatctgttgtttctttgttgactttctgttttgacctgcctagtgctgtcagtggagtattgaacttccccactattattgtgttgctgtctatctcatttcttaggtctagtagtaactgttttataaatttgggagctccagtgttagatgcatctatatttaggattgtgatattttcctgttggacaaagccttttatcattatataatgtttctctttgtctttttaaactgctgttgctttaaagtttgtttcatctgatataagaatagctactcctgcttgcttttggtgtccttttgcatggaatgtctttttccacctttttaccttaagtctatatgagtccttatgtgtcaagtgagtctctcggaggcagcagatagatagatacttggccggtgaattcttactgattctgcaattctgtatcttttaagtgaaacatttaggccatttacatccaatgttagtattgagatgtgaggtactattccgttcattgggctatttgttgcctgaataccttgttgttgtttttttaattgtatttttgttttataggacccatgagattcatgctttaaagaggttctattttgatgtgtttccaggatttgttaagagatttggagctccttttagcagttcttgtagtgctggcttggtagcagcaaatttctctcagcatttgtttgtctggaaaagattgtatatttccttcatttatgaagctaagtttcactggatacaaaattcttggttgataattgttttgtttaaggaggctgaagatagggccccaatcctttttagcttgtagggtttctgctaagaaatttgctgttaataagatagttttttttaataggttaccttttgcttttgcctcacagcccttaagattctttccttcatcttgccttagataacctgatgactatgtgcctaggtattgaagtttttgtgataaatttcccaggtgttctttcaacttcttgtatttggatgtctagttctctagcaaggccagggaagttttcctcaattatttcccctaaatatgttttccaaacttttaaatttctcttcttcttcaggaatgccagttattcctaggtttggtcatttaacataatcccaaacttcttggatagtttgttcattttgaaatctttttaaagtctttgttggattgggttatttcaaaaaccttgtcttccagctctgaattcctttcttttgcttgttcgattctattgctgagactttcctgtacattttgcgtttctctaagtgtgttctttatttcctgaagttgtgatttatttttatttatgctatttcactgaagatttcttccctcacatcttgtatcatttttttttttttaattttcttaagttggagttcacttttctcttgtgcctctttgattagcttgataatcaaccttctgacaattcagggatttcttcttggtttggctccattgctggtgagcttgtatgatttttgggggagtgttaaagaaccttgttttgtcatattaccagaattgtttttctggttccttttcatttgggtgggctatgtcggagggaagatctggggatcaagactgctgtttatattcttttggcccatgggttgttcctttgatgtaatactctcccccttttcctagagatgtggcttcctgagagcttaactgtagtaattgttatttctcttctggatctagcagattcctgggatgtgaactatcttcaggtctctcagccatggataccagcacagtatttgggctgtctcccaggtcctgcaacaacaatccacttccttcaaagagtctatgaattttcttagctttcctagtatattcctgcagtagttcttggagcaaaagttcacaatgtgagtctccacatgctgctctgcccatatgagttggatctgcaatttagtcctgcctcctatccgccattttttcctaccccttctttctcttactaacttctaaactgattatgccacaatttgtctgaacccaactaatagcccaaggcaagggagattggttaaagtagtctttagggttggtctcctaggacatagagtgggatgcagaaaactgatgaacagacctggaggggaaaagaaagaataaacagcacattccacatgttagtttattggttcttcgaaatatcccctaaaataactagtttccttatttttatagaaaaggatactgaggttcagagtgattaaacactttgcctcagtacgaataaggatttgtctgacttcaatttccacgttctttcccttccctataccatgctgcatacccacctgcacccccatacacagtgtttccaatgatgttctttaggggagataatccatggaagtaaaacaatatattgttgcatccgctccttttttattggaattccatctgtatatagtgctgatcattgtttttttttttttttaaaaagagaccaacaggatttatggaggtgactgatcagtactctcaggcaaggaagctcaatcccactatcctactctgcctatctagtgctgcagtttttctgggatgcctaaaaaagacagtaggaatttgagacagtggttctggaacaagacgtgaaatgccattctgagatcctgctgccattaatgaaatggattttgaaggtatattgtgaaggttgtaggttgtgaaggttaagatcattactgaaaaataaagatttattcaacgttttcatttgatatatatgtaatttagacttcttgtggattcctcttagtaagatgagaccaaaatatcagtttttaagacttcattaaaagtctctataactttcttttcaaataataaagatgaggaggtcaaagtattaaatcataaaaagcaggaagataaagtattctcaatctcaggtaacatgcctttcatattttttttagtgttttaatgttaaccttttatctttaaataatttcaacctcacaaaaatttcaaaaaaattttgtatatcttcattgagatttgtcaaatgttaatattttattatacacagactatatatacccagtcatttttttccaaatcatttaagttgcagatataattcaactttattccttaatatctcagtgtgcatttcctaaaaatatatattcctgcctaccagtgcagtataattaaaacaatggcaattaataatgtaaaaacaatgtacaaatcttactgaaaatgtttagttgttccagcagtgccctttatagcaataggggacaaataccttggctacaggatccagtcaaaataataagattcatttcgttttcaaatctattgagttttctttaatctagaacagttccttgatctttcttggcctttcatgacctttatgttttttaaaagattttagtcagttattttgaagaatgtctctcattttgggtcttcctgatattttcttttgattaaatttagcttatccactttgggcaagaataccacagggacggtgtttttgtctttattagtgcttcatacacttagacatgagcacatgtggttgatttgtcccattacagatgatgtttactttgaccgcttgtttaaagtagtgtctgccaagcttcccctctgtatagtttctatttttccttgtaactaatagctattttgtgagatgctaccctgagactatataaatgttctatttttaaaattatgcacctaccagttttagcatccactgatgattctttttcgtctgaaacaattattattatggtgaataaacgccaaattgttattttccaattccattatttcctctacatttgttagttggcattctgtggtaaggaagagctattccttccctcttctccccatttcattatgtatttatttaggtatatatctatggattcaaggattactcttttcttcagtgacttacaattcattattttatttaggcatatctctgtggattcaaggattacttttttcttcagtgacttatacttcattattatcattatttattttgatgctcaaattctcctaaatgttgatagtgggaatttctcatgctggctgttgtatccttttgttatgtctccatcattctctgagcaagtctttattttctggcacagcagtatgttctaggttcatcttgtacattccccaattcatctctagaatcacccatttttaaataatgcttggtccttttgtgaagttagtattataaaccaagatgtaggtgttgttcatgtttactttttcagcagactaatacacacacacacacacacacacacacacacacacacacacacaaaatctctcttgaagtggtctttctcttgacaagaagtagtttaggcaacaatatagtaccttctttagaaaagatatagagcattaacacttttcaagatataatcaaaacttgcaattttcagctggtgaaaattaggaccaaaaaatagaaatgatacactaaagatacaggcaaggatttttgctgccttgtgttttattctgtgcctcaagtaatcctaacttttctttttctgtgcttccctgttctcagagaagtttcttcatgagatctagtttattaccaagatacctgataccatgaaagttgagattcgagtgtagtttaaatcgattcatccaagtgaaaatgttagtgtttggcctggtgttcatgtggtctccacaaacaaccccaagagacagtcagagtcagccggatcaggaaccatgtgaaatgctgtgaatctgagcatcctccccagtcgtgctgagggaataaagtgctgagggttgctccagagctgtgtcctgtgctcattccctggatgaattccaggtgcacattaacagtttaactttgttaagaaggtgtcagcctcggatcatttgcattccattatccacagtgctttttaattttgtgcctgctttggaaagtaaatgatgacattctgctgggagaatttcagcctgtgtgctctttataaagtaaggaaatggagtaattatcacagagaaggagacaagagaggatatgattttcacatttggtgcttttagagagtggtgtgtgttggaggtttcattggagaggggaggtgaagggtgaaaaaatatggggactctggttgtgtgtgttcataattctgaagctagaattgttaataattctggaaatccttcataaatagttgatagaatccacatggatgtttacaaagtcccagctgaattgtgctgagtgtgcacaaagatatacatcatcagaattgtgggtaaatcaagattaaattgtgaaacaataagaggcttatactcaaaggttaagacttgctttgtctcttgaatggtctctagagattaggaaaagaaagcagttgaagagaaccagatagaatggtaaaacatgtctcctctcctctcctcccctcccctcccctctccattttttccctccccttccttccctcttctcttcctcctcccttcctctgccttccactcccttccctccactcctctctccttcctttcactcctttccccttcctttcactcctctcccctccccactccttccttccctcctttctcttccccacctctcctcctttccactccccatctctcctttatccattccttccccttcccttctcttttttctttccttccctttctttcactttcctcccatccactacccttccttcccctcccctcctctatcccttccctccactccccttctcactttctctcccttctctccccttcccttgtggctgatctaccccaacccttctctcctcttttcttctcttccctccccttcccttgtggttgatctactacaacaaattatcactaaatcctatccatagctccaatccatagctcatattaaacaaatgtaaatatcagagtattacaaagaaatatagacatgagtaaagagaggtttactttttagttttgaaaacttaaatctagtaaataagccatgacaaatattaaattagtataataaaaaggaactgacaagcaatgtgaatattatacctgtaataattccccatagactaataaaaatattttactttcatcaagtccactagagtggaactctagcaggacagagatggccttattgatttgttcagtgttatgtagtcagtcccttcaatagttctagatatatagtaggtgctcaataagtactgaatggataaatgaatcaaagggtttacattattttatcatcacttgtttctcttttcttaccctttcaaaattatacttgactcctcctttcccatccactccctaactcactgcagcatcactccataggaactactttcaacagggacaccacactgctgccaaatccacttccttctttccagtcctcattgcactatcctctttgtaacaagtagtacatttctctctccacctttaaactcttttctccctttatttccttcacacttttcttgcatctcctatgtgtctcctcttaacagtctaagtacttggtaatatagttcacttgcttgtcttcgtctgctggtgtttccaggagtttcttagcttccctttttttttccttgcccagtctcctggggtaattacgtcaacctccaatgacttggactataatctctgtgcttaaaaaaatctttcaaggaagcaagtgtagatggaaaagaaatataattcgaagactgacccctgggacacttcaacttttaaatgattggaggatgaggatgaattatcaaagaagactgagaatacatggccagatatagtggaggaaaatccagttattgtagtgtctcagaatccaagagaataattttaaggagcaacactgaaaggcttttatcaactgggtagagtggtgataatgaatcaatgtttccaaccatggttgtagtattctggtaaattcacattattacaagtggaatagcatttttgtttcacttgttattttttaaatgcctagacgaatagatatacatcaagaaaacagtttggatacactgagtttgaatactggctctgcctcttaatgagcataacatggtggtaagagcttggactctggagccatatggcgtgactttaactctggctctttttgtaagcagatgatgtgcttttaggtgagttgtttacattgtttatgtttccatttccgagtccatcaaataggaataataatagtacttcttttataatgttgatctaaagattaaatgagaaaatatactggaaaagcctagaacagtgcgataaaataaattcttagtgactgtttttctgttacggtttgtctctgtgtccctacccaaatgtcaccttgaattgtaataatccctgtggaaggacctggtgggaggtaactgaatcatggggatggttttttcccatgctgttcttctgctagtgaataaatctcatgagatctgatgttttcataaaggggagtttctctgcacatgctctcttgcctgctgccaggtaagatgatgtgtcttgcttcccctacaccttccaccatgattgtgaggcctccctgcccatgtggaagtgtgagtcaattaaatctcttttttttagaacaaaactggaggcatcatgctaccagagttcaaactatactacaaggccacagtaaccaaaataccatggtactggtaccacaacagatatatagaccaatggaatagaacagagacctcagaaatatcaccacacatctacagccatctgatcttcaacaaacctgacaaaaataagcaatgagaaaaggatttcctacttaatgaatggtgccaggaaaactggctagccatatgcagaaaactgaaactggaccccttccttagaccttatacaaaaattaactcaagatgcataaagacttaaatgtaaaatcccaaaccataaaaaccctagaagaaaacctaggcaataccattcaggacatggcctgggcaaagactcatgactaaaacaccaaaagcaattgcaacaaaaggcaaaattggcaaatggcatctaattaaactaaaaaccttctgcacagcaaaagaaattatcatcagagtgaacaggcaccctacagaataggagaaaatttttgcaatctacccatcagacaaaggtctaatatccagaatctacaaggaacttaaacacatttacaagaaaaaaataaacagccttaccaaaaagtgggcaaaggatatgaacagacacttctcaagacatttatgtggccaacaaacatatcaaaagaagttcatcatcactggtcattagagaaacgcaaatcaaaaccacaataagatgccatctcatgccagttagaatggtgattattaaaaagtcaggaaacaacagatgctggtaggctgtggagaaacaggaacgcttttacattgttgatgggagtgtaaattagttcaaccattgtggaaaacagtgtggcgattccttaaggttctagaaccagaaataccatttgacccaacaatcccattactgggtatgtacccaaaggattataaatcattctactataaagacacatgtacacgtatgtttattgcagcactatttacaatagcaaagacttggaaccaactcagatgcccaacactgatagacaagataaagaaaatgtggcacatatacaccatggaatactatgcagccataaaaaggaatgagttcatgtcctttgtagggacgtggatgaagctggaaaccatcattctcagcaaactaacacaggaacagaaaaatcaaacactgcatgtcctcactcataagtgggagtcgaacaaagagaacacatggacacagggagggaaacgtcacacactgggccctgtcagtggctggtggggggcaaggggagggagagcactaggacaaatacctaatgcatgcaggacttaaaacctaaatgttgggttgataggtgcagcaaaccaccatggcacatgtatacctgtataacaaacatgcatgttctgctcaagtatcccagaactgaaacaaaacaaaacaaaacaaaaaccctcttttttaaataaattacccagtcttgggtatgtctttattaacaacgtaagaatggactaaaacatattccatgaatttgtgtttcctcacttggacaagcataacaaataatttcaaactcatagagttatggtgaaaatcaatctaggtaatccacgtaaagtgttcttgcatggcaagacctccatatgtattggctgaattactggaaagtatgtttatcatttagcattggagttaaatgagccagccactcgcttcattcctcaattgagactgctagtggttatggggatgtaagcattatacagccttaaattgtcttattctaagtcatacattgtttaatttatactcttaatgtaccattggttggcaacaggaagcataaggggcattgatgtgcatgcattttcactggatctttgaggtgcattcatctgatcaaaattctcacagagcacatcaaggtgtctctagtgctttgaaaaccaatgttaaaaagataaaattcagtgatgattacatctagtttgattttcattttggggaaataaacactatcttcacaagcaacatggtgttatatgtggagaagtacttgcaaatggaatactgaaaccatctctcttacttcatcttttggaaaaaaaaaactttaaaaataaatagttttttaagtaccaaatgcaataattcaagacatgagatctataaggtaaggtttaatttcatggcttaatttccatctgaaatcaattattaaataacgtctgccaattgcaaatggaaaaagtaaaatttgtctatatggattatgaatactattgaaggttatgctaaattaactatatattatatatgtcatagtttaccgatcaaagataaaatatcgtttttaaccttaattcattttttattgtcacaataaaaacttaaaaaatattttgaaaaatcccaaggggtttttacaaaatgatataagattatgaaataagttcaagtggtaaaaaagaaaaagcttggaaaagctctatttaataaaaaatcatagaggcagaactcagattcttggacctggtctgttaatttggggataaatttgaaatgccagtcttttgagtttgattatagcacttaattatggtaatcactgctaaccttctcccacaaccttgcactcatctccttgagaacatattcttcaggaaagatttaagtttgctttgtaaaacttgctgcaacatgctagtaatcacaattccctaaggctcgcgatttgttttataagaaaaagctattaaatttaaagaaatggtgtacgtagacagttaacacagttgcctaacaccatgctgttctccttacaagacaaatgcatcccattgtttgttccaaattttgggcatattttatcttctgtctttgaggattttgcaaaataagcatattcaatggaatatacattttaactagccccaaatttaaatccaggcacttgcactaatttgttgtggaatattagaaacacctacttaacctagcttacttcagttttctctaccagttactcatctatgacacaacacattttcctatggagagtaaaaagggataagagtggaaaacgtagtcaaaagggaaaaatgaatagatataataagagatggactttgcatttactgataatgatgatgcaacatgaatcatataatgtgaacaactcaacattctgtccctgagctgtaagtctctctatctgttcatctctctagttttgctagctatgtgctagatcctattagagcacttcactcagcaagtacctgacatacagggattcctttcccttttcagctgtctcttctcataacactacatcacctttacatctgtgcacaataccataatagggaacaaaggtctactccaccaatgaatccaaaaattggaataaaaataaatccaggtatatagtcagttatttttcttgatggtgtcatgggaatgatttccattttatcagttggaggttactctgtaaatattactttccagtcaagcaaataggaaagaatatgttttcatgaaactgtgtagcttggctctgtttttgtttttcccagctctgtagagagagagcattaaataaaacatactctgccacgtttgcacacaccacatccctcatgttctaaagatactacattgtagaaatgtaattgactattgcatgctttcctctcatacctttcccataatttggaaaaaagacaaaatcgaatgtgtagagtttacagaaaccacaccaaagaaaagcaaagcctcataagttcaataaaaatccttttttctggactttctttataaaatattgaagcaacattgcataaggaggctgttgaattcttccatgacaaaaactgtttctgaaagactattgttatcatgagatcttctgagcattttcctagaagtagaagctgaacttcctttttcaatggagatgaggagatagatatatgttaaccaatctttaaaggggccatacttgattagactatggatgacagctctttggaaatcatagttggaaatggagggttaatagagggagcggggaggtccaacacagaccacaattcttttagctactcagtctcaaaacattgacattccatttaacttgttgccttctttcattttccttctgtagtctgtagctactgcttgacaattgccattcttaatatttttcatcctatttctttcagtgacacaggcattaacacatgtatactgcttttggacttaatcgtgctctcctctctccaaatgtagttacattaggggttaaagttgaagccaatatttggccaatattggattggacccaatatttggagatagggtcttaagggaagtaactgagattaaatgagatcataagggcagggttctgatctcataaggttagtgtccttgtaagaaaagacataggagaggtcattctctctgcaggtgtacacaaggagaaaggccatatgaggacacagtgagaaggtggccatctgcaagtcaggaaaatagccctcaccagaagcagaaccctgctagaccttgatcttggacttcaggccaccataactatgagaaagtgagaaaacaaattgctattgttaaagctttccagttcgtggtatttgttaccgcagcctgagcagtctaagacaaggttaattacaatattccagaattagagctatgtatatattatgccagatttcaaaaaatctttgcaaaagccctgtgttaatgaggttttattatagatgaagacactgatgttctaagaggttaattcactgaattataagaactcagaacttaaagatgtaggaactacaatttgagccttgctctattttataagtgtgtttccttcatgctactgacaatatcaccctaggccaggccctccttgttcagtgacttacttggttcacagcatctccctatagctacccagcactcttgttaattttgcacacttgccaagtcctaaatcatccattttgttgcttcacttccactgctcaagctcatttaatgtacctgtgagagttcccaggacaagctccaaatccttaaccagctttttaaggtgtgttcaaaatctgagcccacttaactaaaaggtatgactattttctcaaagctcaaatgccaaattccaattcacttcactacgtcaagattatactacattaattcttgtatttataatcctatctatggtattccctctcctggaaaacacttttctcatccctccacacacaaaacttgtactcatcatctgaagacagactcaatccaggcacttgtataaaacttttcttacatcagtctatagtgacctcctacttaaaactctctagacttttttgggcaatttatttcttttttgctattgggttgtgtgttatttcctacttgtcttatgtttaggaggaatttttcaaaaagcaggtggggaaggcaggggaacaaaaactctttgaatgcatgctcaagtatctagccaacaaatcaagcagccaagagatctactaatcaatacatagttactgagcacttactatgacctaggctttgcaaaactgaatggcattggctcgaaatatattttcctttctgtatttcatggctaattccaatgatgcaaagacattcaacaaatgacaatttatgaaatacataatgatatcgctgctatgtgcttgaaaaccaaagaatagccaacacaatcttgtctttgttcaccaataacatcaacaaggaattgtgactagagtaggtatttgatctatgggaagacagcatggtgtgatggaaaccatatggatgttagaacaatttaaatcttacctccatctactttgtccttttgtcctcccagataatgattaaacttttctaaatcatagtttccctatttaaagtttctatcatagagtctggcccatagtaaatgcttaatgaaatgtactaaatctcctaattgctatttgtgttcattgaaaatcattaaatagagagccttgttatcctgttaactgtactctttttatgtttattgctgccccaacttttccctgcttcaaagatgagcaatatgcatagctggttctaacacatggccaaaatgctagtctggctttgaatggggcgaggagcagataatttggaggggatgtgctagaacaaaggtactaaatagaaggattgtatgtgatcactttttgtcgcactcatcatcccttacaggaagaggctgatttgctgaacttagaaaaaaatgtgacagccaatccttcagatgcattacaatgctttgggaaaaatataattagacaaaacaccaagtatcgatggattgcatgttggggtgatgcacgtgattagagaattcatcgctttacttagtaagacctattagacccattgttagttgtcttttgaatcaagagatataaatgattataaaactgcaaataacatcccattatttttaaaataatgaatgactgtgaaccaaggtagttctattatttccaatggaaagataatttgagctgatacttaaggctctgctcagcattacatttggaaaagtgcaatttaattggtgtgaggcagcgtagatttgtgaaaataaatcatgtcaaacacatttgattaccctttaaaattaaattgctattggaccagctagaagaggaaacaagtaaatgcaatacaactgaattcttttttaagtcgcctggcaacattccttatcagtgttaagcatatggataggtttcagataggtttataagtaatagtcaagtggcaatagacaatgggtgccaaggttgaagatctagaaagaaacatagcaattctttggaatggctggaaaagcacaaaatgccaggaatggagggataagcagacagtttcaaggtcaaatattagcactgccaattactgactttgtgacaagtcacagtctttgaaacctcaaattttggatctataaaataagaatcataatagtttctttccagggttcttgagaagaacaaatccaatggttttaaagttcagggctcaacatatagcaggtttccatgggatgatttttctcactagatctagaccctaggccacaaggtgacttcccctgatcacataggactctagggagtttggggaagcaaatacttcaatatgctgtcaagactgtgggtaatactgaggtccaagctctgctgtactcttgagccgttggtaccttatatatgtttcaagtgttttcctctctgtaaatacctgtccaagagatcagcactgtaaaacccagcttagttctttggaaacaggaaacttgaggaagttgaaaatctttacaaaaatcctgaggtaaaagttccaacaagatcaatgaaagccttttggtaaatgagttctgcagtactttgaacctctctgtggcaagatatggcaagaagcctcatgtatccaccttgtcactgacatctgttctaattctctgcatcgtgccagcattattgggtgcttttcttgtttatagcatttgtgtccatgcttagtcactgcctcctcttataggaatgtaggtaagtcttacaagaatatgaattttccaagaactgctagcccttacagttgctaatctagtacggttgctagcttagtgtaggcacccagataaatatttgttgaatgaattaataggtcatggcaaagaacaggagttggcaaactatggcccactggttaagtccagcctatgacctgttttgaatggcctacaaagacagtcatgcttattcacatgctattgcctgtggctgctttgctgctacagtggcagagtatgtgtttcctgatccacaaagtctaaatatttactatctggcacttcagagaaaaaaagattgtccactcttgattcagaagatagaaatcaatactgtgatagtatcaccatcatcagagcagctatcacatatgtcttatatggacaagacattttaggtgctttcatttgctctcttaacagcctttgcaaggtgggtcttatttctgctgtcttgcaaatgaggaaactgacacccagagaagtcacttctgcaaagatacagagctgagtgctatctgagctcaaattcacccctgccctccacctcaacctttctgactctatagcctttgatttttatactaacctaagctactaatacattttagtatagacattttaagtgaccatgagaatattgttaaaattttcagtgtttccatttccttgtttatcatggatttagggtagaaataattaaaacaaacaaagcaataataaagatgtcccagcctcgttttgtaagtttgttgagcataaattgtctctctattatgtttctttctttgcttgtacttagtagaagggattacagagacgatgtgtactttttttttttttaatttaccactgacattaaaacggaatgttaagaaacccagctagaaccatttcacagaataaacactgagagattaggcaattgggcttcaaagtggaatatgaaacttaatgtggctaagtgatgcacttgggtagaaataatgcccaggctaagtacaacttaaatggtgcttaattagttaatacagcagagaaaaaaaatccgcctgtactctgagaatgaacatttacattttggattcactgtgcagcagtgatggaaagagctaaaatgctgtcagcttgtgttcagagggctattctattagtcctgggatacgggccttttgtaaggtgctgattggaacacaacaaggcatctggtccaattccggactcattaagtaacaaaaaagatgaggagtctgtttccaggaactagatacttgattagtgaagatagcagcaagggctggagctgaagcttagcctgctgaacagaagccttaagcaccctctgggatggggctcctgccctctccagcctcattccatggttccctcctctcctggtctgcatgatgcgattttaacaattgccacccccttcctatgtgataatgatgtgcactacaacccatcccacagaagggacaatttagcttgtgtgtctgtttccccaggagaaagcaagctccttgaggctggggtctttgtcttatttacacaggcattactggaccctacactccctttcctactacatagaatcttatttttgccctttccctttctccttttcttccactgaaagagaaagggaggctaagtatagctacatcattaattatgaaagagtttggggaaggacaaagatagaaaattcaggcagcatgtttatagaagagttttactggggaaaaaaatgctaggggtggagcagaagagagcattggaattagaaaaatgtgtatgttatgaagcgttgctgtggattgcaaacagggcctccttactttctaaaatatacaaatccatatttaagttgatttttaattaattatggctatggaagtgcattgctttaaacataatcccactcttggtctggactgcatggttgttacaattataagtattacattggtatccccagtgcccatagagcactagacgggttgtggaaattaaagtatattttgaataaatgaatgagcaagagggaaaagaactgggtgatgctaactagggagtgatctaatagaagacagaactgtgccccaatactcttcaaagtgtttcaggtcagcataataaattagtgatgggagcctaaagcactgctcctccagggtacataactcaccaggacgtgccttgggagctccttcagccccaaagctaaagtgaacaggctagagagtgtattttttttttcccatgaatctactaaaagaaatccactaaaatcaaataaatcatgaaagagctgtaacgtagacttggattagagtttgctaattaaagagcatttgaccaagttgagcatgcggctgttagagagagtgaaattatgccatgcatgatgggtgtctacgtgtgtctttccttgaacgcgcacacaaaggctgaaagcataggcaacaggagagaagaataacctgtgtcgatagctgaacttttactctgtctaggcaacacatgtggacaccagctatgaggcataggagttataaatataattgctaccaccacttccttcaaagaatatatagtgttagggaaaggggtgcatataaacacagaattaattatgaggcaatgataaggggcccaagaaatacaacccatgtgccgttaagttgcagaggatggcaaaggcacattttactggtgacagggataaaggagttcaaggctcaggtgatatgtgaatcagaactcaagtgtagttgaatgtcagtgggctgagctgagagggaagggcagaacacaaggatgggaagcacagcaaagactcaaacagatcataagataaactatcagtgggaaattagcctggaagcaaggaattgaagcagtttaaactctaggggatttggagcaatggctgtcttatcaaagccatgtgtgtgtgcagataatcaggagcctgagtggtatgagacatcatggagtggtgtgaggtctataagaaacagaaacaactaagattcaaacgtctagaaaaaaaagtttacagaccctgaatgccagcataacctttcagagcaggcatgattcagctttcctgacaaagtcctctactgtggagtaaagtcgtgaccttgttgtcaataaccctctgaaagtcaacatggctcccaaaaagagaagaaggcttcctgatgcttctaggcttcattgcttccccattctaccacgatgtaaagggtcccctgaagggaaacaagcagggagcatcaagggaggggcccctgctcagcatccctcctatttggagcttccttgtctgatgtctcccagcaggcatgcaatcagtctgcactccaagtattttaagtggtgtgctcaccactttaaatttttggattattgaaatttagggttgctcaaataaagttaagtactttaatgatcttccgtatgaccttcctcctcatcccaccatgcctctgtactccctgcccccagcacttttgctggcccagacgtgggaatgtaatctgcttttaggaaggggagatgtaagaaattgacctggcccagcaacttcactgatttaagcctgcaaagctgaatgctgagaatggagttgttctgctaggtctgaagtcagagaatgggggaaaataatctaaatcctgcacagtgaattagtggcagagacctatgtacctgttattgttgctgttcactatttctataatggcaaattatccttatcacccagcggagaagtcacaaaggaaacagctctgatggactgctctttggtattgcagctcctgcccctcacacagctacaatctatggtcttctcgtagaagcgtttatacctgagtatttaataccaagaaataagaattcacagatttttaactcataactgaactgatcccattttcatggtgatttagtcttattttacctttctttgggtctttagcaaatagaatagttactgattgatgtggaattgataatttggaatgaaaactgtattaagcttattctctgaaattttttgaggaagaagatagcttggtggatctgttttatctgcaagattgtgttactaagtagggatggctgttggaatttaaagaaagaaagaaagatgaaggaaaagcacagggaaaatgtataattaatgagttttaattgattagtttgtggttattgaaatataaatcaggccgggtgcggtggctcacacctgtaatcccagcactttgggaggctgaggcgggcggatcacaaggtcaggagatcgagaccatcctggctaacatggtgaaaccccatctttactaaaaaatacaaaaaattagtcaggcgtggtggtgggtgccgagtagtcccagctacttgggaggctgaggctgaggcaggagaatcacttgaacccgggaggtggagcttgcagtgagctgagatggtaccactgcactccagcctgggcaacagagcaagactccgtctcaaaaaaaaaaaaaaaaagaaatcagttattttcgctattgcattttagtttgctagtctattggtagtaatatctatattttaaagtgtgctagggatttctcctccattcctggaatctctctaccattcccagtctaggtctttctcaaaaggatttcagtgaagatgctatacactgcagagtgttacagtgaaggtgactgctaaatactcaacccagtcctttttttttttaagttagcattgctgcatgggggaaatctgaaaggctcggaagtgtagtggggtcccatggagggctttagttgatgatgtgtattttaacatctctcccaggatcaggtagggtacatgtcacttccatttcatgtgactttcttcccagtttgatctgtagctgagctaaatgtgtcattggtagtcactgcttaaaatttctacagcttggaagatcccagcaagatattaaagataaccaactgaccaagacttggaagggagcaagaaaatagaaaaagcagtaagaaaaaagctcacggctatctccagccaatactcagctttcagatgtcagaatagaaaggacacctacacctgagacaattaagacatttgattcaggagctcataacatagatgtcaactatcccaaagccgtcattgctaagatttggaatagatgcataaaccaaatttattttactcaacaaattgttaaattttaaataaaggacctcataggtagattgggaatccaaatgaggtggggaggttaaaagctcaggttctagggttgactctaagggcctactggaacccttgtccggccatttattacgtatgtgatttgggagaagttgttttatcattctatgcttcagaagtttttgttttgtttttacctttaaggcagagatgataatataaactgactcaaaaaatattttgtgaattaatccacatgaagtgcttcaggcaattgcctggtatatggtaagtgctcaaatattaactattagttaaagcaagatggaaatatgtcctaggtgacaaaatggttaagaggcaaagatgaaagaagccacaagggaagcgaagggcaggacaaggagaatttgagatgaaatgtgataagagctgagaacaaggagaaggagtggggtagcacttcataatgaaaagtattagtttccattttataaactcgatttctgcaaataaaattcatatatcaggggcaaaagcaatgggctaatatggtcagtgtggaacatgacgatctcttctaattgacctactaaacccaggggagaatgctctataaacagattgctaggctaagcaatagggtgccccattatccaacaaggaaggactccaccaagaccagaggctagattctatgggtcattgtaaagataagcacatttagttcttccattacaattcttatatagcccctccttttgaagttttcaatgttttgcagacatttcccagaaccttcacatttcactgattggccagttgccctagggagcagaagtagccttagccaagtagaaaagcaaaggcttggctccctggaagcatgtttgtattgcctctgattaatctggacttcagggatctttgttttttgccccattgatacctcccagaaaaatgggattatagtatcacagccatatttgagatggcagatttgggagaatttaaaacccaattcaggccgggcatggtggctcacgcctgtaatctcagcattttgggaggctgaggcagacagatcacagggttaggagttcgagaccagcctgaccaacatggtgaaaccccgtctctactaaaaatacaaaaattagctgggcgtgatggcatgcacctgtaatctcagctactcaggaggctgaggtaggagaatcacttgaacctgggaggtggaggttgcagtaagccaacattgtgccactgcactccagactccagcctgggcaatggagcaggaccccatctaaacaaaaaaattattatagaaacaggagaaaaaatattattaatattggctgtgtatgaacaaaacagccagagccagagaccctaccactgaagtaaggctgatcgctgcccagctagaaaaccatcctgtgttgagttcatgtcttttgtacagacatggatgaagctggaaacaatcattctgagcaaactatctcaaggacagaaaaccaaacactgcatgttctcactcataggtgggaattgaacaaggagaacacttggacacagggtggggaacatcacacactggggcctcgtggggtgggtgtaggcaggagggatagcattaggaggtatatctaatgtaaatgacgagttaatgggtgcagtacaccaacacggcacaggtagacatgtaacaaacctgcacattgtgcacatgtaccttagaacttgaagtgtaataataagaaaaaaaccatcctgtgttgatggagaagcaagcaatcaatgcagcttaacaaagcggcagtcagaaggacaaatcgtaccccaaaccaaggggagatggaggcatccgatgagaaagaatttggctagttggagttatgaagggaaaacaatgcttgaaaaatctgaggtgaagttaatgatcacagaaggggtatgtagccaggaggaggccaggaaatgaaggacttttttaaaaaaaattgtatttcataagtctgttttctaaacagaaacaaatgaagtaagtctttttggggaacaagagaacaatggtgattccaccaagttaactattaatattagtcctatccacccttaaatctaaacatttctgaataaatttgattggaatccctgcgtctggtactgctaaaagttttggcttctggtctaactgcctaatgaaatcaacgatctatccctcaacacccctttccccccattcagtagtctcccttttctctccaaagagaaaaaaaagttcatgggaatggctctctgggaaacataccatcaaaatttagtaagtgatagagcaaatataacaagaaaaaatatgtaagcatttgagaagagagggagacaaacttcaagtctgtgggggagaaattgggattcactcactcaatggctttttcttcccccagttgacctacaagaactggggttgggaaagtcagcagcagtcagataggagacaactctgtttttaaatctatatagccccagttttctgctgcctccaagcaccttacatacaatagtaagttaattaataccagctctgagtaggcatgtgagctaaagatggggtagagaaaacatccactaatctaaaaagaaaaagaaaaagacacagcatccttatagtgaaggttgaaatcttcatcaggagtaaagccctctttgcattcctttctatgcatagggagcagggtgagcttcccagtaaaaccagactccatcctgaagcttttctctcagatcactaggggtcattcattcagtcatcctatcctccctcccttcccttttcctccccttgccttcccctccctccctttctttgttccttctttcctttttatcctcaattaagatggtaaagggtgatggaagacacaggaatttttaagtgagccaacttcagtttaattaccaacactaaaatgtatcacttgtgtgaacttggatgaagtaattagtctttccaggtattgatttatttctgttagatggaaatacccgtgcctgtttagcaaggtgggaggatgaggataatgtgtgttcaatgtccagcacatgctagtgctctcttggtttctgtgacacttctttccagcctctctggccacggattctcaagctccttagccgatttttccctagctttctcatctagtcacaaaatgttgggctgcttcaggggttgactctgatttcccagacctttgcttatttattttctatcttaagtgatcaacttaggtttaaatgacaagtatatacagattactgtcaaattaatatctctaagcttcacttttctccacagagccccatacttacatgggcaatcaatcctgtgacatcttcgcttggataactcagacttaacctgactgatgatgataaagacttttttctccacctcctaaccttgcacattattccttgttagttttttcacctggatgaataacactactatctacccagttaccaggctcaaatcctgggggtcatcaatgatttcttctcttcagttatgtttactttctgtcattcctagcctcaaaatatatcttgaataaccaacttatttttgttcttaatgctaccactgtagattgtattaaagttctcaagtattccttcttcttaccatagaacatgtagggccactccacttatggaaggaatttacttcgctgccaatggggccacttgagatatgtggctatagatgggaaatgtgatcagttcctcagcttttcattgctctggtcaggactatagtgggcaacagttacctttagccattgtggctgtcagacaagtatgatagaaagaatgcgaagttgctgagagtgaatgtcaggggtgagtataccgatgggccatgggacataagaaagaaaagaagataagaaaggaagtggatagatcgctagcaagactaataaagaagaaaagaagaaccaaatagacacaataaaaaatgataaaggggatatcaccaccgatgccacagaaatacaaactaccatcagagaatactatgaacacctctacacaaataaactggaaaatctagaagaaatggatagattcctcaacacatacaccctcccaagactaaaccaggaagaagttgaatctctgaatagaccaataacaggctctgaaattgaggcaataattaatagcttaccaatcaaaaaaagtccaggaccagatggattcacagctgaattctaccagaggtacaaggaggagctggtaccattccttctgaaactattccaatcaatagaaaaagagggaatcctccctaactcatttaatgaggccagcatcatcctgataccaaagcctggcagagacacaacaaaaaaaaagaattttagaccaatattcctgatgaacatcgatgcaaaaatcctcaataaaatactggcaaaccgaatccagcagcacatcaaaaagctaatccaccatgatcaagtgggcttcatccctgggatgcaagactggttcaacatatgcaaatcaataaacataatccagcatataaacagaaccaaagacaaaaaccatacgattatctcaatagatgcagaaaaggcctttgacaaaattcaacaacgcttcatgctaaaaactctcaataaattaggtattgatggaatatatctcaaaataataagagctatctatatctatgacaaacccacagccaatatcatactgaatgggcaaaaactggaagtattccctttgaaaactggcacaagacagggatgccctctctcaccactcctattcaacatagtgttggaagttctggccagggcaattaggcaggagaaggaaataaaagatattcaattaggaaaagaggaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatacaccgataacagatcaacagagagccaaatcatgagtgacctcccattcacaattgcttcaaagagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaagagagcccgcattgccaagtcaatcctaagccaaaagaacgaagctggaggcatcacgctacctgacttcaaactctactacaagtctacagtaaccaaaagagcatggtactggtaccaaaacagagatatagaccaatggaacagagcagagccctcagaaataatgccgcatatctacaaccatctgatctttgacaaatctgagaaaaacaagcaatggggaaaggattccctgtttaataaatggtgctgggaaaactggctagccatctgtagaaagctgaaactggatcccttccttacaccttatacaaaaattaattcaagatggattaaagacttaaatgttagacctaaaaccataaaaaccctagaagaaaacctaggcaatgccattcaggacataggcatgggcaaggacttcctgtctaaaacaccaaaagcaatggcaacaaaagccaaaattgacaaatgggatctaattaaactaaagagcttctgcacaacaaaagaaactatcatcagagtgaacaggcaacctgcagaatgggagaaaagttttgcaatctactcatctgacaaagggctaatatccagaatctacaatgaactcaaacaaatttacaagaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcccaccagttagaatggccatcattaaaaagtcagggaacaacaggtgctggagaggatgtggagaaataggaacacttttacactgttggtgggactgtaaactagttcaaccattgtggaagtcagtgtggcaattcctcaaggatctagaactagaaataccatttgacccagccatcccattactgagtgtatgtccaaaggattataaatcatgctgttataaagacacatgcatacatatgtttattgtggcactattcacaatagcaaagacttggaaccaacccaaatgtcccaacaatgatagactggattaagaaaatgtggcacatatacaccatggaatagtatgcagccataaaaaatgatgagttcatgtcctttgtagggacatggatgaagctggaaaccatcgttctcagcaaactgtcgcaaggacaaaaaaccaaacaccacatgttctcactcctaggtgggaattgaacaatgagaacacatggacacaggaaggggaacatcacacaccggggactattgtggagtggggtgaggggggagggataacattaggagatatacctaatattaaatgacgagttaatgggtgcagcacaccaacatggcacgtgtatacacatgtaactaacctgcacgttgtgcacatgtaccctaaaacttaaagtataataataaaaaaaagaaaacaaagcaaattgatggatttgactaaacggaaaactagaacttatatatggcaaaaatatacaaaagaattaaaatgtaaatgaaaatttgtgagagagaaaaaaagaagaagaaaggaagtgagtatgtgaaagagatgagggggagtgaaaaggtggcaggaccaatgcagtgggcgtgctggcagagtgggaattgttggagtcaaagtttggatacttgaaaagcttgaaaatgagattatgagggagtaagatgactaaatcaaaaggtgttgagtaggccgggcgcagtggctcaagcctgtaatcccagcactttgggaggccgaggtgggcggatcacgaggtcaggagatcgagaccatcctggctaacatggtgaaaacccgtctctaataaaaatacaaaaaaattagccgggtgcggtggcgggcgcctgtagtcccagctacttgggaggctgaggcaggagaatggcgtgaatccgggaggccgagcttgcagtgagctgcgatagcgccactgcgctccagcctggatgacagagtgagactccatctcaaaaaaaaaaaaaaaaaaagaaggtgttgagtatgaccatgacagtgaatggctaaaaatcaatgacaagaacatcggcaataaggaaaccaaggaatagaggggccagaatgttggaggggctaccggtgtggatcttgaagtcctcaagaattatgacaagcattagattgattcagtgctaaaatatttaaggaaggaagaggagtgacctgaggtgtataggtgatagcatcatggatgaatagcaatagtgaaggtataatcttttggcccaaaaatcacagcagcagggggcaagggtagaggtaagggagaaagaatagtgacctggtggtgacaatgaggaacagggaggatatttgctccatttttagcataaaatgttgctataatttgaatatttgttccctccaaatctcatgttgaaatgtaattttcaatgttggagatggggcctggtgggaggtgttggggtcatgggagtggatccctcatgaatggcttggtgctatcccttcagtatagtaagttcttgtaagacccggttgtttaaaagtgtgtggcacctccgtcttctctctcttgcttccactgttggtgtgtgacaagtaggtttctctttcaccttctgccatgatttttagcttgctgaggtcctcaccagaagtagatactgacagcaagcttcctgtgcagcctgcagaaccatgagccaattaaaccttgtttctttataaataacccagcctcaaatattcctttatagcaatgcaaaaatggccgaatacagtggtatatgaagcatgagaaaaaaagcagccactgtttgtgagggatgcaaaggaggtagcattcttgaagggcagccagcagagctaaaaattaaatgtgggttgaataaatgaataaataatagctattattacatttcttttaaatttccaatatatgacaagctacaggagaacaaaatacattgtttcattcaaggagctcataggagctctggttctcatgtatttccaagaaaatcatgtacaatgaaactaatgcacagagacatggtctagatgttacgggaacacagaaaatgatcaagtaatgcttccagggtggtatagatctctaggatagggtaggggaggttttccagggaaagggatggtttaaaggtaagtaattaattcctgggaggtcagtttagcagagcatgggtgaagtctgaaaggtatgagaacacattaggggtaccaggcttagctgaaaagttgtggctgcctcttttaccaatgtagtatcagcagacaaaggcttgagataaattcctttgtatgcgtgaatctgcctgtgtgcatgtgtgaacatgtgtgtggcaatttttcccatggaactcttccagaaacattcctttgtaaagtagggtttctttctactggtaggtaggacatggggtggtgtgagctaccactaagtcaaagagcaaggtgacattgtgagttgtgttctgatgccactggtaggtatgcattatatgcatatgtgtgttatcattctggatgaatcaaccctaagtacaaaggcatgcacacacacataccagtgattgctgcagatttcactaaagcccttctaagtatagctatgattggaggaagaatatactggactatgagttcttaaaggacagagccatatcttattcatcattgtgttcccagtactaattctgcatctggcaaacagtatggtcaaaaaaaagatggtattttgttcaaccttcaccaatgaagccaatgaacagataaatgtgagaaatcatctagcaatactgtcataggatataatagtgcttgtttagagtacattgtgctttgtaaattttaagacttttgaatatacattaacttattagatgccataaacaaagccctgagatgcttatcaaattctgctttacctagcaaaaaagctctcaattacttggcagagctgtgactaaatcttttgttttctggtccatagttcagtgacagatgcaagatctggaaaaggcagtgcgctttagcaacaagaaagtcagggccaatttgggttgccaatatgggatagtgggaggagagtggacctcagagtcaggcataactggatccaaatctcagctctggaaacttgagttgtgtgaactcactctgtgaggatcggtttctccatctatataaagaaagcaattgtaaccaatagatgaaggttaacttaggattgagcaagataatatgcatagtgtttggcacaatacgcggctcttaaagttggtaggtactatgtattattattattatttgaaataggttcctgccttgtcacccaaggtggagtgcagtggtacagtcactacttactgcagcctcaacctcctgggctcaagcaatccttctacctcagactcctgagtagctgggactacaggcaggcaccaccatgcccagctaattgtttttatttattctgttctcactatgttgctaaggctggtctcaaactcatgggctcaagcgatcctcctgcctcggcctcccaaagtgctgggattacaggtgtgagccactgcacccagccagtactatgtatcatcattatcattggatacaccaggttttagtggcagttagtttctgacaaggctacaatgaatggtagaaacgtcgttttcctcgttggtcagatacacgtggggagcttttgagtcttggcacagttaagaagtcagtgggaggaaaaggatattaaaatgcagaacacgtttaaactccctttggactgtgttgtatcaaggaaatggaaaagaaagtgtcaggcagtacttgggatgatggggactctagtgataatgacactaaggcaaaggtgcaaaacctgtgacatgatggccaaagagggaatgtgattgcaccatttaaatgtatatcaggaaggtgtgagacatcctgccatactcagggaccttccacaccacaaaggtgacactaaaattcagacttagggagactctcttggccaggagactggctaaatgtgcgaattcagaagtatcagctgagatgtgacgcgatcacacatgggctggcaacgactattttgctctgaaaaaggtgccttgggaaagagatatcattaattttttttaaattttagtttgattcccattctatgttttatggccctgacactggactatcaactaatgaacatagtccttgctggataaaagaaatgtatagggatagttcttccccaagaacttgttttattttcaatgacaaaaaaaactaaattgctttcagcttcattatcttttcaaactcaaatgtaaagaaagagcatcagaagcaggagtgtgcaattaaagctggaaaagtaaaatagagtttatctaataataatgggatattttccataggcagaagcttaattctgatttctcaatttaaagactctaaggagaaatcaatttatagactcagagaatcactgaatgttaagttgcaaaaatcccacaaatcattttgtgtatcccttcattttataaatgaaaggactgaggtctagaaaggttcagtgactgcttatccagtgaatttactcggaaatataagaacaggtgcagttaagatgaagatatctggatatatacttagcttctacagtgacttactgtgtacccataagcaaagcttttgcaataggcaagttccttgatctccctttatgcaaatgatatacagggaaacattgtttagaccttacttctagcatgtacaatgaacctatacaaaatggtctacattcttggttccctctcctttcttggaatcctcagcctggcaaagggtctaacagtcattgaactggaaaggatgtacctattttatagatgtgataagtgaggtccagcaaaactaagtaaccgtaccacagttacccaggaaatacacagtgcaggtggacctggggcctttggcttcctgctgcagggttctttccattccatcatgtgacactatttaaatagaagcaggctagagttgacaaaatgagttcctttccatttgcatgaggcactgagcttctaaagaaattctattcataaaagtcaacaagtttctttttggagcctgtccacaactgcccaggcttagggtagaacgaggcattccaagtcctcagtcagacaggtggccccataggtatcagcagagcctaccttttcgcctccagcatcttttcagctgcctttttactcagagccttgtggagccatactgaagcctggggctaaataaaaaaaccttgcctttatttagaattctgatattatgctcatcatgaattgttttgcattaagttttgttttttaaaatactacattaagacattatttgtcttgactactgagggtttttctttttcttttcttttttttgttcacatcttttaaaattttgtgtctggagttatcaaggggatagaattccaggtttctctttacttgctgtagcctctggtttcactgtgttaaaatatagataaaatgggcccattccacccattttccagatgaatctaacctgcacatccagatttagtttgcactaggaaatggacttgtgaagccattcacatgggcagggattttgtgtgttttattctctgatgtatctacagagttcagtacatttagtttgtagaaacccaattgatattcattggataaataaataaatgcaacaaaactctacagtttttagtgtttatgacctgttaacatttatctaagctccctccaatagagtctcctaggcctgtaaccaatttctggcaagtttctgggaattgagctctctgtcttgccaggtctctagagtattctaaatagataaagagaacaatagtgattttcaaacaagccactattaatgttaggttttaactgaaaaatagctcaaatgattaactattttctgaaatcttcgctttttctttgtttctttggctctttattttagggtcaggaggcacacatgcaggtttgttatgtgtataaattgtgtgtcactgaggtttggtgtaagaatgatcctgtcactcaggtagtgagcatagtacccaatgggtagtttttcaacctaccctgctttccccactttagtagtccccagtgtctaccgttgccatcttaatgcccatgtttactcagtgtttagctcctgcttatgagggagaacatgcagtattttgttttctgttcctgtattaatttgcttaggataatggcctccagctgtatccatattgctgcagtggacatgactttgttcttttttatggctgcatagtattccctggtgcatatgtaccgcattttgtctgtccagcccactgttgagcatctaggttgactccatatctttgctattgtgaacagtgctgcaatgaacatatgagtgcatgtgtccttttgatagaatgatttattttcctttgggtatatactcagtaatgggattgctgggtcaaatggtagctctgttttacattcttagagaaatcacactgctttccacaatgcctcaactaatttacattcccaccggcagtatataagcattctcttttctccacaacctcagcaacatctgttatttttttgactttaaagtaatagtcattctgactagtgtgagatggtacctcattgtggttttgatttgcatttctctaattagcaatgttgaacattttttcatgtatttgttggctgcatgtatgtcttcttttgagaagtgcctaagattgaaactggactcttccattatatacaaaagttaaatcaagatgaattaaagatttaaatgtaagatctcgaattatgaaatcttataagaaaacctggacattggccttggcaaaaaatttatgaccaagtcttcaaaagcaattgcaacaaaaacaaaaattgacaagtgggacctaattaaactaaagagcctctgcatagcaagagaaactatcaacagagtcaacagacagaatgggagaaaatatttgcaaaccatacaaccaacaaagatctaatatccagaatctataagaaacttaaataatcaaacaagcaaaaaactagcaactccattaaacatgggcaaaggacatgacatatttactttttaatcactcttaaactttagaacattttattttaggtccgtgggttttttttctttcttccatcatcccaggcttattcagatacaatgtagggtctcttgctattagtgtttccacagttaagtgcatgggctgccatttgctttcctggtagccttgactatgtgtccccatgtttctggacatgaaattcttcatttgtcatctggcaataatgatagttattacaaactgcttggaaaaaaataagaatgcatgggaatggactttacaagtggtaaagagaacacaaatttcagagtgtataattacaaattccatgcaaaagcaaaaacttcagatttgtacctattttattttattttatttatttatttattttgagatggagtcccactctgttgcccaggctggagtgcagtggcatgatctcggctcactgaaacctcggcctcgtgggttcaagtgattctcttgcctcagtctcccgagtagctgggattacaggcatatgccaccatgccaagctaattttttttatatttttaatagagacatggtttcactgtgttggccaggctggtctcaaactcctgacctcaggtgatccgcccgtcttggcctcccaaagtgctgggattacaggtgtaagccactgcacccggccttatatataaacaaatcaggggtcaaaaagagaaaagacatgaattatgtccaaactattgaattatgttcatagcctttctggaatgatagtaggttcagttgattttttgttttttacattgaccatcctagaaagaagtctcacgtacctgaaagtctctcgagactaacttcatgggggacacagtctgattctcttactctcatatgcacatccaacattctcagatcctaagactagagattctccaccattgttgaaaatagaaaatgtcaccagggatctccaaattgtgctgcgatctttctgctttttatattgtcaccaacaataaatattctgcagtgggattttagctgacggttcaggtgatgatttgccaagcagcaaagtctccagctttgttcttctgggattctatctgatcctgcaaagctaggaaggaaatcttgttggttttctttcccacttctgtaatgctggcagatgagacttgaaagccaacaagatacaaagatagagagaggaagaagctatcattttcacctagaattttctccaccaaccagactgactttcaagttgcagagtaagtcactgacctaagataacagagtagcttgcatttttacagatgtcttgaagtaaagcttgcttatgtgtaaggcagcagctttggaagccagaaactggggtgtcttgaggggtagtaagcctctgaaatgtgccccagggaactggcttgaccgttgattctgaacaaaataaaaactcagttctttaaggaccatcttcttctttctgcatttactcacgtggcattcctcaagggcactgatctgcagtcactctgctttgtctggttatcacatgaagattgagaggaaggtttacttaacagtcttatgaggcagatgttactgttatccccattttacagaggcagctactgaggcacagcaagattaattgccttgcacaagaatttgcggacagtaaatagcagagcaacattttgaatgcaggcagtagggctctagagactaataaataaacttaatttattcttttataccttagtggtctgaaaaaataataatttcatttattcaaatgatagtgcatgtgtatgcatgtatatttgtttatgtgatgttttccagcgttataggttttattagtaataggttgatctcatataatctactccaccacagctggaaattgaaatttcttgtgatgtgattttacaactgtttgtaactatgtagctgcccttgtcaatgcctttttttctcatccttgttttccagattttctgtttattttgtgagctccctaatattctttctatgcatttctaaattaggcagatttggttttagttccttgtagttaagaaccacgattgatttgaaatgtggagattaagaaagatagtactcttttgaaaattaagttcttgaatatggggtaagtaacaaggagttcacttttcctcattttgaaggcaatatagtattcactatacagactctaagactagactgcttggaattgaggatttgattctagactgtgccatatattagctgtgtgacttaggtaagccaggtatgtatctgtcagtttctttatcttaaaataggaataatgatagcatctgtctcatatcctcatctctgagcattagaagatatattagggttctctagagaaacagaaccaataagatatatatagatagatatatagctatagataaatctacaaatatatatatagatagatttgtagatatatatatagagagaaatatatacacacatatacatatacatacatacaggagatggctatatatcttatatataatatctctatatattaatactatatacatgtatatcccgtatatatcctatataaatcatattatatataaatatatatatcttatacatagggatttatcatgggaattgactcacacaattatggtatccaagaagtctcaaggtctgccatctgcaagttggagaaccaaaaagccaatggtatagtgcagtctgtgtccaaaagcctgagaactggggataaggggtgggggtagagcttgctcctgcacagaatctgaagacccaaaaacagagagtgtgataaaaagttttctcttcctcttcctttttgttctatccaggccctcaacagattgtatgatggccaaccactgtgaagatgagagcaatcttttttactcagtctaatcattcaaatgctgttctcatccagaaacacagacacccagaaataatgctttaccagctatctgagcatcccttagctcagttaagttgacacataaaattaactgtcccagatgagaatatttaatcactgcttgggatgggacctggcacttagtaactataatataagcattaactactattattcccagtggtttgttgttgttgttgtatttaaatatcactaacatgcattgactgtttactatgtagaagtcatggtactaatcattctatatgtgctcgtaacaatcttatgaggagctatcattagccatttataaagaaaagtgaggctcagaaaattcaaagatcttctcccaggatctcataaacaggaattggcaaatgtagtattttatcctggttaaaagtgtctttatcctttatgggaacttctttgggaagggtaaagtccctttgcatgggtcgtatacacccagaacactctgccttcatacacttactgctgatgagactacacagtccttctcaccattctgtaagtaaactcctcctcccttctctaggtctatgacatctccagtgaccccttatacaggttaaatttgatcccctctgataccctcatgagaaggggagtgacctttattgaaaccgttctttgtactggaccctgttctaggcagtttgcatatgttttcttttcaaatgatcaggctataagcaaccctaggacatacagccatatctgttttgacccaaggcacttacgttcttaaatgttatgaaagttgttcaaggtcacattgtgacctagaagtagagtcaagattgaaaaccaggcttgtgtgactctaaagtatatatttctgtgtaatataaccctgagtggggtattccaataagaaaaatggctagagtggtaatgaaataataattcaattataggaagaagtatggcatgacaggtttcatgaacttgatagcagggagtgacaaggagatcttcacttggaaaagatgtagagactaagaactgttatatgaagggaggtgatgaataaagagatttaagagagtaaggagaggtgtgggctgtgcctcaggtctgcaagaggtgagagatgagtgctgaaggaaagctaggtagaaatgggcatacatccttcatgctggttctcctacctgctcagagccacagccggccaactcctatgctgtggagtcattgtcactggtggttcctatacttctctattgcgacaaagcaatgaagtgacatcaggaaaaatgaggaggagacaacactggctctttccatgatgaggccagatgactccttcccactggcagcctctttagttttttgtggttcttaggttggttctctgtagacaaaccaaaaagaagataaaagagcaagcctttccttacatttctgccactgttccctgagtgagctgatggggaatatgttgtagaattgtgagggaacaataagggaacaggagggaaaccatagttccctcccacaaacacatatacatgccccagattcaggatgtgtttccatccagttttctattttcttttgtgctcataccttgatatgttcataggcatcatactcagtgtgaaataaagatgttgtttcttggcatatagttataataataattattattattatttaagacggagttccactcttgtcacgtaggctggagtgcagtggcgcgatcttggctcactacaacctccgcctcctgggtttcagagattctcctgcctcaacttcccaagcatctgggattacaggcacccgacaccgtgcccagctaattttttgtatttagtagaaatggggtttcaccatgtcggtcaggatggttttgaactcctgacctcaggtgatccacccacctcagcctcccaaagtgctgggattacaggcatgaggcatggcacccagctggcttataattagattaaagccattacacacacacaacttaaaaacacacacacattaatgctgagtgggcagatttcaaaggaaaatgcacacatatatattgaagatcattagaacatctatctatctatctatctataaatcaaatctcctgtcttcctccaactattgcacattttactactaccttctattgtctcttttgatatagagatacagactgtgtgtgtgtgtgtgtgtgtgtgtgtgtgtgtatttcctgctacaaagagagatatatatatatattttatttgtctgcatactgtctctctgggtctctttcaaatatcttattttgtcaaatgaaggtaaatttttaaaaatgaataaaattgcttggcacaagtgtgctatattttaaaatgtacataggcgtgactcatggcctggcatgtagcaagcgctctgtaaacagtagcaggggtgccgtacctcacaggtgtggctgctagaatttcaataaagtagaaatgagatacgacttttatgctcactttgctcttgattctcattgcttattcattttaattgtacagcaaatatttatggaggtgccagcacatgcttggtgtggtgcttgacaatgaggataccaagtttactgcagcaaggtctatgacctcaaagagctcagcattgcaaaggagataaatattatgaataaataaagtttattgggccaggcatggtgactctcgcctataattccagcactttgagaggccgaggtgggcagatcacgaggtcaggacatcaagaccatcctgtccaatatggtgaaacccatctctactaaaaatacaaaaattagctgggtgcggtggtgcatgcctgtaagcccagctactcaggaggctgaggcaggagaatggcttgaacccgggaggcggaggttgcagtgagctgagatcgtgccactgcactccagcctgggtgacagagtgaaactctgtctcaaaaaaaaaaaaattatttagcacctatattatgctagatactctgcctagtgcacttctatatagcatctcccatttaattcacataacaactttatgagtgggctccatgatcaattttttacagatagggaaacagacgtagagaacttctgtagcttgcccaaggccaccaaggctataagtgatgtcactggcattcaaggctattctcatgtaatgtcacagcaaataccctttttcatattgtgaaacaatttggctcttccactagccgtaaactacaccgcttcatccatcatcccttttaatattcatgtaaaattgggcatagtctccatggggataaggacataagtatgcatgctggaagtataaacaggcctgcgacattaatacctggcttttagacatgcttatgagggtaccctttgaacatttttagctcccttcagcctcttatttttttctctctaaactcctaggtcaagaaagtatcatgcatttggaatcctcacgtattatgtttgatcattggtaatttctggtatgtgtatttgcttcttagaagtcaagttctctggaggcaaagatcctagcttgtaacaatcccccttatgtctttttcctgacaatattttctggcatttatatgccctgtactgtgctgaatgctatgtgtagaagacactgtgtttgtgacacataccttgtcttcaaattgctgatagagaagacaaaaacatacagaatattattgaagcaaggtgctgaatggtgcaggaatggaagacaaggcatgttttcagtgactgggggaagggagctggaaggttgctggggaagtagtagggcctggaaaatttcacggaggaggtgatatctgagctgggcctgatcaggtgaaaggattttgctgaggagagaaacagctgatgcaatttccaggcaaaggtgatattccttgttcaatgagagccataacaatggtgatttattccaggtgtcttaagacacattatttctggttatcacaacatctctacaaagtgaagtttgtttcgttttcttttaaatcaccatttcacagacaagaaaatggaggtttcaaaagcctaacaaagtgcctatgatatctcggcttgtgagagtatgagccagagtcaggagccaagttcttcctgctataaccacattgtgtagtatgagctgagccttgatttcctcctacgtagggtatgtttcagggagaatgacatctgggagaatgagcacagctgagcattattaggtggggtttcaatggtaaagatcccacatactgctgctctgctccttttataatattccataagggaaaatgtgaccccttttaatttcaagatcacatttcactttattattaatgaaaacatttgtcaaaagcatttggtgtaaatgtgcagtattttaaaatgtaaatgggcttcatgaaattaactttttctgataaacatagatgcaaaaatccccaacaaaatgctatcaaatcaaatcaaataacatatcaaaaaagttaatacaacataatcaactagtatctatcccagggatgcaaggaaggttcaacatacacagataaataaatgtgatatatcacatcaacagaatgaaggaccaaaaccatatgttcatctctacagaacacagaaaaaaatcctttctgtgtctattgagataaaaatatgggatctttatatgttaattttgtatcttgcaagtttactaaattcatttatcagtttgataaaattcaacaccgcttcataataaaagctcttaataatttaagcatagaaggaatatacctcaacttaataaaggtcctatgtgacaattacacagctaacatcatacttgaatgagaaaaaattgaaagcacttcctctagaactagaacaagacaaggatgcccactctcaccactcctgttcaacgcagtactggaaatgccagccatagcaatcaggcaagagaaaaaaataaaaggcatccaaattggaaaaaaaaagaagtcaaattgtccctcttgcaaatacatcatctcatatatagaaaaacttaaagatgccaccaaaaactcttagaaatggtaaacaaattcagtaaactggcaaaatacagatttacatacaaaggtcccatttttaactacatgggtttttctgactctcttcatccgttacgcattattgtccattatgcattattgccaatattctggcaatagaatattgtctcatgtgacatgaaatggggttctgaagtcaaatgaatttgggaaatctaagttatacaagaaacataaatatctctattgcaggcctaagaagtctttaatatgctagagtgcattataaggctccaaaagatagaagttgtgtgggggaagataatttgaccatgaagccacttctacatacttaaaaaaatatcccagccaggcttggtggctcacgcctgtaatctcaacagtttgggagtccaaggcaggaggatcgttgagcccagaagtttgagaccagcctaggaaacaaaatgagacctcatctctaaaaaaaaaataaaaataaaaaaattagctgggcatggtggtgcatgcttgtagtcacagctactcaggaggctaaggcaggagaattgcttgagcctgggaggttgatgctgcagtgagccatgatcacaccactgcattccagtctgggtgacagaagcaagaccctgtttcaaaaatgaacaaataggctaggtgcggtggctcatgcctgtaatcccagcactttgggaggccaaggcaggcagatcacctggggtcaggagtttgagaccagcctgacaaacatggaaaaaccttgtctctattaaaaatacaaaattagccgggcttggtggcacatgcctgtaatcccagctactcaagaggctgaggcaggagaatcgcttgaacccaggaggtggaagttgtggtgagccaagatcgtgccattgcactccagcctgggcaacaagagcgaaactccatctcaaaaaaaaaaaaaaaaaaaaaagtaaaagagaaaaaaaaatttttcacaggatccatcaagattcattttttttttttcggggggagcaagaaattagacatgtgagagtaacaggtgaaaaccatgatttgcaatcttcaaaagacctgggttcaaatcccacctctgccaactaacttactgtaccagctcccataaataatctatccacccttagaataacagacttaccttggcacttggaaagtacaggaaatggcagcaactatcattattacttttatcattgtccctttcaaaaccctaatgcactggaaacaagggaggatgcaaagataattttcactccttaaacagcaggatggcagagaggactggatacctccagggttttgtgacactaagtttataaagaccctccctctccagaagggtggcctaatgaatcactgagccctgctatgaagagaaatgtttatggttttctgatgctgcagctggctagttcgataacactcttaaataacccctttcacctttaaagcctgatacatttgcctcctgtttactgttccaggagttctaaagctataaaaataacctcactttaaagaggcaatacatttttttttaaagcataaaagtgacttggctagagccttagtaatttaaagaatagaagcccagcaagtacatttcattcactacagctcagtcttctatcagggaagagttggacagttttgtctcttttgttgtaaagtataaagaagaaaattgtttccctagcatccccatactgggattgccccagacctttcagacatgggagctcatgctgaatttcattaactaggtaaccattaactgctctgaacctctgtatatataaattgaagaggttaacattttttgctccagcttgcccacccagaaagttctaagattcttgacataaaattgttgccaggtatgccccacactcttgtgttcttttagtctgaagatctgagggaaggagtaaaattgggagttctgctaacatgcgagtagattcaagatgatccaaaattgtccctgattttaaggagattgctgtctaattggggacataagactgaaatagaaaacagtcagtgtgaagttgagtgatgattatggcacacaatttataagtgcttgtagaagattagtagacagtgtgattacatccgttcagaaatggcttcatggggagctgggtagacagatgaatgagtgttggacagatcaagaaaaagaaggtgttctattcaggatctttttactggcaaagataaggaaatgatgtaaggtatcccaagtaaaaatcaagttttaatacaatgataaggtattttgtgaattccagttaggaaagaaaatacagccaaattttaggtgaatagaaattgataactggaatgccgcaggatccagaggtgagatcccctccatccctcagaggatacacagttgactatagatcctcaagtatacctgctcaacctcctctctctcagaggacacatggaagaacgactgcttactctttattttgcctgggagcacactcaaatggcagctccagcctctgaatggtaaaactcctctatgtgggcagaacactacacatcatttgctactagccagtcttttgattgcatcctcacaagttaggggaccactgtggtttgtcagctatgcccaagggtagggtcacatagtacagaggacttttcgttccaagggctacaggcaggactgtttatattagcaggaaaaggttcctcaacaaggaagacaaacaatactgctggtgcaaagtgtcacatcaggttacagaaaatgaggggcagaaacactgagcctgtaaagagaatttcctagcccaagtgaacagtggtctaaggcaaagcaaaaaaaaaaaaaaaaaaaaaaaaaaaaaaaaaaaaaaaagaattcaaccagatgaagcatggctttgaaattcaaggaaatgatgaatgattagaaagaaaataagcactgataatgtaaataaataggataatggattttgaccattatggtggggacaatgttgaagtcttgaactataagacatcatagttctgcatgttgatgaagtctcttgaaatttagatcaggaggcaatcaaacagcaatgagaaaggaactctatacactgttctaattgaccttcaggaaaagaatttagtcccttactgaattttgaaacaccacagcttgatgaaaaagatccttggctccagtttctaatttagctttaatatttgctagcagacattttttttttaacctctccttgttttagttattcaatctgcaaaacaaaaggacaatgcttacatttaagagttattttaagaattcatacagtgtgcctaggatagtgtctggtatatggtagatgttttataaatgttaatttcagtttttctctattcctcttcagatctaggtccatattaattctctttatccactggagttttttttttttttaaactatgagtggcttaaaacccatgccacgctaaagatgatgaaagggaagggtaagcttttttgtgtggagaggagggttgagaggccggcagtgactctgaaccagcagtgaggcattgagccatctatactcactgatgacatggctattctttttattgggcatacataaagaaacgtgacccagactgcaaaggaccaattgtgtcacagcttctttcctagaggatttcctttttgtactttttatgagcccctacaaatggaatcagacggcatggcttttccagacattttgtagaggaagattgattaaaattagttacagatgaaacaatgccctctgcttttgtcgagtccctttgtcaagaaatatatgacagaagtgactaaactcttctttacccacactttggcaaaagccaaaagttgtttctctgttaatctgaccttatccttatttaccaatgaggctttctttagcttgttgttcccatgggcttgaagtatcacgagatcagattatgggatgcagggaaggaaaaagaagcacctaccctcatcttctgtttgtccctatgttctgcctattgcctctgcctctccaagttacctccccgtaggccagtctcagggctgtggctttcccaaggatttgcccattttgccacagagagggacttggactctgataatattgccattagcagtgtcagaaaagaacctctttccttcagtgctctattcattcctctgatagaatctgggtaaatacaagtctccttatgcagaataaacagtccctgctgctctctctgctttggtctgttagtcactaaattaaattctgcattggaaagaatcagaagcctacaggtagcttagttcagcaaataatgagaaaaccaaactgaaaatcaacatacttcaatgcttgttatatggataaattctgtggacgctgtgggggtaatagtatcatatataatttattcaaaaaatttgtattttgttttgtagcacctagatgaaagcagggctcaataattgtaagctggatgaatggatgcattttgaagactcccaaggagcgtggtcacagcaatgttaaagacttgaacatatagctcctcaagacacccaagttatatttttctttaaaaagtatttttttaaattatttatttcgatagttttattaaggtgtaatttacgtatcttaaaattcatctacttaagtgggctattgactttgcgattatttttgacccaacatttgttataatggaaggaaggaagaatatctctctgactgaaactctaggggagcctaagggggttaaatgttatcatcaaatctgtcactcccctaggttctggggaacatctttcaaatccacttcatcctattttcatccttacagcttctcagaaccacctgggctgtttttcccctcttagtaggctgagcttctggcaagagagcgtcccctggtgtcgggttgtgagatgaaggttgtggccatagtgcatgtgggatcttcacttacatacactggggagcgttcttacctgaataacccaatggacctccattagaggagtgtgcttttaaagtgcagattcccaggtttcactttccaaatggctggttctggagggctaatgtaggcccaagaaatctgtattctaaagaagaccccaaggggattctgatgcggatgatccctgaaaaatatctgagagcttctgaatgaccttatagcaatattggaaaggttatgagttggaaatgttgactgccctagtctaaccagttctagctttaactacctaatatggcctttccagtgtatctgatcacacacccccatcccccgcaacacacacacgtctacacacaatctttatttttgacaaaaagaaaagacaagttgatatgggtaagttaggaaaagataacttagaagtaaaataaatcataattttctgggaaaatattttttagaacaatgccatcttatttaaatatatatatttactttcaagggatacagatacatatgcatccacccttccaaatgttagctgagaccagattcttgctgagaaatgaatgaaatgggagattcaactctagtttaaaacacaaacatttccaatgactaacggtttcctgccaccttagttaaggcaggacttcctattgacaggaataattagctttggaaataaaagtggaaatggaaactaaggatgctagctgacgagcccgctttgcatatttatatattctgccatgtctttgcattgtgctttctgctcaggaataaatttgcctttattgtttgtcccggcctaccccattctcacagagctcctgccgtgccaacagagatatgaaacaaggccaagtgatctgctattgaagctggaagaaatatctccctcccagtgaccttcctagataatgagcagatatggttttctaatataaagggaataaatcaagggacctttcagggaatcagggcaataacagtggagtccaagaccatcaattccgaaagcaaagggcagaggcacctttctttatagatcaacattagactaaggcaagaagggagacattcacccccagagggggggaggagttaaaatagatcagctctcccttccccgtgtttctcccaccctccctctttgcactgagtcctgagactaatatgggagaaaatcacactttcacaggatgtctcactcgctgttattttctatcagttgagttaatacatagttttgagagatgggttgtttgtctttgcctttaactcattataattttttggtgtgaattcagtgctagacccaggtgccagattggtgtcattctgcaaacctctgttgatctgcggagcagctctatcctgctcttggtcttcatctgaaaccattgatctctctcgagaagtacctattagggatagggctaaaagcggggccaggaagagtttgggaccaggtggaccactgggggaagacaaggtaatagagtatgtctttccgtagacgtactgctgtttgctgatccatttcttatatatgtagcaccaaaatacaccagtgaaaacaaaggagagagtatgtttaattcaaggaatgacatcctggcatattaagaataaacatatagataattttgatagaaataattgctatttgctgaggtcttagtatgtgatgggcattgtgcccaatctttctgaatatattaaccttgaagaaggggtattattatccccatttaaaaaatgggaatatagaggctgtaagtttacatgacctgctctgaattacacaagtatagaaaatattaagtgaaacattatattgagggccgtctgacccccaaagtccgttgttttaaacatgcatctatgccacaggaaaagttgtcagtaaatggtctaaaaaggaggtgcagagaactgggaactactgcccagagaggctcagtctttttctggaccttatgtaggaaccagttttttggaccaaaatcttggtcaaggggagatggcattgagggcctggcattttcaaatactacgtggtgcatgtcagatttcagaaattttatttaaatcccacctcccgattttatctgtgaagaaacagacctaaaggggaaaatggattgtccaaggctgagccgaaattgtaactcaggtctttggtgtataagcctctcctactggtagccagtcattatttggtggcagttaaaacatcttgttaacgcagtaagatctatttagctcatctttcccatgacacctggagaaccccaggcacttggtctcacacaggctgtcagcaatagatttgggacagaaactcacagcccaacaccatgggcaccagagcacatctggtctaagatactctgatgtctctctttcaggtagagaatacagctcccattctttgatgtgctaagaagccagggcagtgcaggatagtgacccatttggttcctgttggggcttcttgtggttatgcctctcacctagtacttcatcccagtaagggcctcccctctgcctcttttctcccttccctgaagtctgttcaccacactgtagcccaagagagttttcacaacacacctggttatgtttcgctcttattgacaagatgaagtagactccttccgcacatccttcttcacatgacttatgcatgaccttgtaagaaatggttgtttcttgttctgtaaacccatccatattgaaaaggttttatttcttcaaacatgacatatgtctcttgcctctgagcctttaaccttgctattcccagttcctaaatctttgtatgtctggcccaagtcctggtcattcctgaggtctcagtataaacatcacttcactcagtaagtttacccttgatttttttattttgggttcagaacataccttgcacagagctcaggcctagacttatcaccccatattataattccctgatcgtgcacatcagcctccaccgatagactgtgaggtcccaggagctggtaaccatgtttgtctgatttacattatatccccagtgcttaggagaaggtccagcacaaaataggtaccaaacaaatatttcttcaatgaagcacttattggatgttttgtgaacacatcctttctcttctgtgtattttatggcagccactgtatctagtgttggtcattaaatggagaggaaattagtatgacgctggccccctaaagacttcagtctattggccgaaacacatgtaactatgcaacaacataggcacacacaaacaatataactataaattctgataaatattctatgtaaacattacaagagaccctattacatggtgacctaaactttttcaatcatagattaccttctgatactgtttaactattaaggaattgataagatcgcatgaaaaaatattcagtaactcagcaattaagtggcatgctcatttccataatggaaactggaagtgaatagggatgataccaccaatgtctcagcttcacagccccccgagcatatgcaccccaggactctagagggatcacttttgcccttccgcctttaaaagagcatgggccccaaatataggccatgatttcatgctgcttttccttagaaatccatggccatgagaggagaatgtaagagtattttcctgcctcaaataatgcttattaaggagtttgtaaaaatatttgaaagaaaacagtaatagcccatgtctccattgtctagatggttgctgatgacattttgtagattaaagtaatatacaaacttagttagaaaattaaactgacagataaaaattgaaataaataaaaataataaaacatacaaaattgcaaaatgtctaagtatgaaagtctaaaaaacacgaagtgaaatttcttgccaaaggcaataattcttttcttttattattatactttaagttctagggtacatgtgcacaacgtgcaggtttgttacatatgtatacatgtgccatgttggtgtgctgcacccattaactcgtcatttacattgggtgtatctcctaatgctttccctccctcctccccacaccccacaacaggccccagtgtgtgatgttccccttcctgtgtccatgtgttctctttgttcagttcccacctaggagtgagaacatgtggtgtttggttttctgttcttgagatactttgctgagaatgatggtttccagcttcatccatgtccctacaaaggacatgaactcatcattttttatggctgcatactattccatggtgtatatgtgccacattttcttaatccagtctatcgttgatggacatttgggttggttccaagtctttgctattgtgaatagtgccacaataaacatacgtgtgcatgtgactttatagcagcatgatttataatcgtttgggtatatacccagtaatgggattgctgggtcaaatggtatttctagttctagatccttgaggaatcgccacactgtcttccatcatggttgaactagtttataatcacatcaacagtgtaaaagtgttcctatttctccacatcctctccagcacctgttgtttcctgactttttaatgatcaccattctaactggtgggagatggtatctcattgtgattttgatttgcatttctctgatggccagtgatgatgagcattttttcatgtgtctgttggcagcataaatgtcttcttttgagaagtgtctgttcatatccttcacccactttttgatggggttgtttgtttttttcttgtaaatttgtttcagttctttgtggattctggatatattagccctttgtcagatgagtagattgcaaaacttttctcccattctgtaggttgccagttcactctgatggtagtttcttttgttgtgcagaagctctttagttgaattagatcccatttgtcaattttggcttttttttttttttttttttttttttttttttttttgccattgcttttggtgttttagagatgaagtccttgcccatgcctatgtcctgaatggtaatgcctaggttttcttctagggtttttatggttttaggtctaacatttaagtctttaatccatcttgaattaatttttgtataaggtgtaaggaagtatccagtttcagctttctacatatggctagtcagttttcccagcaccatttattaaatagggaatcctttccccatatcttgtttttgtcaggtatgtcaaagatcagatggttgtagatgtgtggtattattcctgagggctctgttctgttccattggtctatatctctgttttggtaccagttccatgctcttttggttactgtagccttgtagtatagtttgaagtcaggtagcatggtgcctccagctttgttctttttgcttaggattgtcttggcaatgtgggctcttttttggttccatatgaactttgaagtagttttttccaattctgtgaagaaagtcattggtagcttgatggggatgggattgaatttataaattaccttgggcaatatggccattttcacgatattgattcttcctatcaatgagcatggaatgttcttccatttgtttgtgtcctcttttatttcgttgagcagtgatttgtagttctccttgaagaggtccttcacatcccttggaagttggattcctaagtattgtattctctttgaagcagttgtgaatgggaggtcactcatgattttgctctctgtttgtctattattggcgtataagaatgctggtgagttttgcacattgattttgtatcctgagactttgctgaagttgcttatcagcttaaggagattttgggctgagacaatggggttttctagatatataatcatgtcatctgcaaacaggggcaatttgacttcctcttttcctaattgaataccctttatttccttctcctgcctaattgccctggccagaacttccaacactatgttgaataggagtggtgagagagggcatccctgtcttgtgccagtttacaaagggaatgcttccagtttttgcccattcagtttgatattggctgtgggtttgtcataaatagctcttattattttgagatacatccatcaatacctaatttattgagagtttttagcatgaagtgctgttgaattttgtcaaaggccttttctgcatctgttgagataatcatgtggtttttgtctttggttctgtttatatgctggattacttttattgatttgcgtatgttgaaccagccttgcatcccagggatgaagcccacttgatcatggtggataagctttttgatgtgctgctggattccgtttgccagtattttattgaggatttttgcaacgatattcatcagggatattggtctaaaattctctttttttgttgtgtctctgccaggctttggtatcaggatgatgctggcctcataaaatgagttagggaggattccctctttttctattaattggaataatttcagaaggaatggtaccagctcctccttgtactgctagaggcaataatttttaatactcaggattccctgcagaaaagttttctagtcaaataactgtgtgtgtgcatgtgtgtatatatatgtaattattattaataccaaaaggagtcattcaacaatgttgttttgtacttttttatttttaattattaagtataagatttaaaaattaacacatagtaattttacatatttatggggtacagattggtatttcaatacctgtatacaatgtgtaatgatcaaatcagggtaattgacattttatttttcagcgaaaaatagaacctggtaatttctgtataacaataacaccgaactccctttttctttttaatagctgtgtaatcttttgtcttatggctagatcatcagttatttaacaagcaattgtagttgtttgtttttgctttgaaaaacaatcctggcaggaacattcattggcattttccttctagtgtaactgtaaattaggtattaagcaatgggattgcttataagaatgatatgtgatcattttattttttattttttaatttttttaaacttcaggggtacaagtgcaggtttgttgtgtaggtaattgtgtcatgggcatttgttgtacagattatttaattgcccaggtattaagcctagtacctcttagttattttttctcgtcctttgcctcttcccgccttccaccctctgataggccccagcgtgtgtgttgttcccctatatgttcatgtgttctcatcatttagctcctacttataagcaaggacatgtgatatttggttctctgttcctgcattagtttgccgaggataatggcttccagttccatccatgtccctgtaaaggacatgatctcattcttttttgtggctgcatagcattccatggtgtatgtgtaccacattttttaaatacagtctattgtcagtaggaatgtaggttgattccatgtcttcactattgtgaatagtgctgcagtgaacataaatatgcatgtatctttataatagaatgacatatattcagtaatgggattgctgggtcgaatggtatttatgtctttaggtctttgaggaatcaccacactgtcttccacaatggctgaactaatttacagtcctaccaacagtgtgtaagtgttcctttttcttcacaaccttgccagcatctgttattttttgactttttaataatagccactctgagtcatatgcagaaggttgaaactaaacccatttcttacagcatatacaaaattaactcaagacagattaaagacttaaacataaaaccccaaacaataacaactctggaagacaacctaggccataccattcaggatgtaggcatgggcaaagatttcatgactaagatgccaaaagcaatgtcaacaaaagcaaaaactgacaaatgggatctaaataaactaaggagcttctgcacagaaaaagaaactatcaacagagcattttatatattgttagatattgctaaattaccctccaagtcacattgatcagtgtaggagtagattcatttcttgcagcctcctgagcaatgttcaatgaccatcttatagatgaaaactgtattacatatcttatttaaatgtttttaaagtgaggttgcatatttttggtctgcttactgatatgtgtatttcttaagatgctaccttaagatcagttagaaatgaaaaggtttattattagcacatcctaaatacacacaggtttgcacagacaatggtaaagcccttttagggaaaaaaacatgttttaatcacaggtcccagaattttagagatgttcatctgtcattaaaggcttcatattctatttacaaaccaccctcaatctaagttgttctggaatgatctttagtagggagcactttattaccttggttcaatttgttctctatatggaataaattagctttcaccttatgtcattctgtaaatcacacacccctcccaatggcccatcttagcaggagttaatgtaccacaggtggacattctagaacctctacttatctgtttgtgtgccgtgatgccaggatggagaccaaaaggctaaatgaagccctcacactgtgcagcagttactccatcagctcacagctctgtccctcccaactgatatattccaatctttctgattttctgtgtatccatcttttcagtctcattggaactagcatttgtagcctgtgggtttgtgatgtgctgggtcctgaagcaaaacagatgtgtttctgaaatgtgtcttaatccatccagattttaaagacaaagccattcatcttttatctggtacaaaagggatttctaggttcttcctgaggtaatgagtttgagtctagtgatgtggtgataggagatgcaggcagattcttccatgtctgtcatcaccttcccagatccatgctttagggagaatgcaggagcacaggaactcagccctgtttctgctccaggctctaccccattgccaggggccagaggctgggcaggaaggctccctgtactctttttactgttatctatatttttcagactgacattaaggatgacagccttctcccacctccaaagaatagatacctttgaagccatattctgggagaaaaagttgttaagagaggaaaccaaactctctgtgaccaaacctttttgttttttgttgcttataaaaggagtagctatttatttagtaaatgcattttctgaaccaaaaatcaaggacccttgattagatgagggacattaattgctaaattaatggaccagaatattgcaattttcacatacaaaatttccttggtacagaataaccagtcaatttatctttccttgctcccgccctttcttcagtccttctaaaaacaaggcactgtttataagacgctgtcctattttctcctccttgacaactcttttcttttaaaatcactttgttctgtaaatttgttacccttctatctaaatctgttaaaaacagagacaaacgcatgtagagactgtgtctctatgttatatagataatatgtgtatgattatattatgtggtctcaatctggccctgggtggtgtcagatccatggtttttctggctcaatctccattcttgctgtgttagccaaggactctgaccaatgatgaggcaccaggtacgtttttatgtctgcttcaaggagcttcattttcagtaaacttgcttagggacacacaagagtaacctggggcaggaatcaaggctttctttctttttctttttcttttttttttttttttttgagacagagtcttactctgtcgcccaggctggagtgcagtggcatgatcttgactcactgcaacttttgcctcccggattcaagcaattctcttgccttagcttgctgagttgctaggattacagacacccaccaccacacccggctaatttttgtatttttagtagagacggggtttcaccatattggccaggcttgtcttgaacttctgatctcaggtgatccacccaccttggcctcccaaagtgctgggagtacaggcgtaagccactgcgcctggcctcaaggctgtctttctaactgtcaatcatgtctaggtctgaagagtgaggggagagatgcccctttatctcacctacaaacacttgtccaggttaaactctgaatgtcagaacactgaacatgtgaatcacaagtctgtctcccttgcttagatgcaggtctccctctatcccagtgtcttttcaggttccacttgctctctagagctaggcatcagtgacttgagagtagggccactgtacttccatacctcctatgtcctaagcatgttgagaatcttactcatcatatgctgtgacaattgttccacagaaaagaaacctaaatcaggaaacttgagtcaaagacttggcttcaaccaaacaacagcatccatcatactaaattagaatggttaattcaaattttattagtagaagagctctaactataatatattttatgtttgtgcagatttaaacactattattttaaaattatcaacaaatttaagggaatattcatatttaaaagggattcgtgcttactccaagtttgtggaagcatagccttaattagtacttgtgtttgtcttttcatgcagatatatcttgcttgcccagctagattataaaattcttgagggcaggtgccatgagcaacttgatttttggaactcaagggtaccaaggaatttaagcaacaatcaaacaatattgattgattaatggttctgtcaccaggtaggttctgatgtctgggttttgtttattttcctctggattttttaaggattgagagttgtgcatggttggggttcttggcaagaagagagtacacatgtcaactcttttgtgtctgtccatgagtccaaagggctcctgatcccattaatccctgacagagattcctgcagggctttgatgtgtatacccaccccaagtgagtaagtgctcctcgtgtcctgaaagcatcagcctggcctctcctcagtgacatcttccactccggtgttcaattgtggctgtgcagctttattgttgcttatggcactaatatccctgcataaagtggtttctttattcccatccttttatctttttgtgttccctgttcagaggcactgaccttttagcttgcatgcattgccaggctcaagagaaaacccaatctgtcctttacctggcaattgtagctcatccccattcctctccccttatcccttctctctcatatccatcctttgctttcgatttcattttcttccccgtatcacatttggagccttactaactggagagaaggagggggtatatgatgtgggacttgagatttatcagaaacctttcattgcaaaatgatggcatgggaaattgcatcatccatatatatgtctgagaaagaccagatggagaaaatatttccacaatgtgacggactttcatactactttcatacttgtgtctgctctatggaaaagaccaaaaggaaaaaggaaaggagggagcaaaaaacaggaaggcaaataaaagtagggtggatgacctaatgtttttggctgctggttcaacccatccctgctcaaaattaaaatgaaaacactctacagtatagaatggaaagtgtggaaattctattctatacttcatttgaagtttgagttattattacagctgagtagcggacagaccaggaacacccagagtcctgagaaggcaagctttctgtgttaggtttagagtggtgggtgaaaagcacagctaaagttaaaatgccaggaacaagaagttgcccatcttcttcaaggagcaatggacaccactgccatttcctgagtcttttctgtttttcagatataacgtaccgttcattttaggttgacctcaaagtccccctcttccaaggattcttccctgattgacaaccctctgtatacttctatgctcacttgccgctctatcttacttttgtgaatgtgttgagttcttgtcctgtgcctctgttccttcatgtactttcctgcctgactgcatggttgttgagagtagacagtgagtgctttcattttagttcttcccagctattctttcctattagacaaggcagccttgcactattgttacctgacttctctctagcacaggacatcttgcttcacccttaagaaggaaggatgaggtagtgttggggaggagactctaccagggcaatcagtcagattgtgcacagctggatttgtttccccaagagctggttcctaaaagatatccattaaagtgacaatgaaaaaagatggctagaggctggaatttccccatgctgtttagccaagagcccagatggcttggatgctcttcttttggttctcagttgaggttagcaaattccccaaggggcatgcagaaatatagtagggtcaattataggttgtcatactgaccagagggaagaatgggtaatattagcatttgatgccaggagccaggccaaacaaatatcttgaaatatgcaaaaacagctcacagaaaaagataagtccccatgaaattccagtagtgcccccgcccccaccaaaaaaagaaaaagactacacagccattttctcagaaaaatttcagattccaagtgaagtttgctatgtaatcttcaaatcccttttctagagtccatttattcatgcatgaactttctaaaggaactaccatgtgctggggattggggactcatcagttcataagatagacacaggccctgcctgttggctcctgactaagtaagaggtgaagaagaggacagagatgctgcccttccatgccatgggtgttttaagaagggaagggcagagttgcctgggcaggtgtggaaagaatttaacctagaataagggaactggggaagatttcccatagtagctgattcctaaatgaagatgaggagttctgagggtgagagaaggagggtctggggtggagcgtctataaccaggacccactgtgtgaagtagagggtgcagcatttgtaaaacctggagcatcatgggagtgaagttcagtatggccgatcgaattgtagattgaagtcaaaagttgttgagagggaaaaaatagacagagcttgtcttataaataatggtaagtagcttagagtttgtcaataggataattggaagacacttaaggtttttaaggaagaatattgacagttcaaatagctccctctggctgtagtttggttgtgttgaccaaatttgaatccaataaacatgtcttttttttttttttctccccatcctctactcattccgcttgtaactaattacttacctacagatccccagatccccagagactgtcatatattggcttttgaaaattgttcattaggctgagaatttacaactaaaaacagtatacgattttctgagtatttataaattcctatcatctctgaatgtctagacaagtttattcatgattaacattagatgctgacttctgaagatacatagaaaaagcgtggtccttcttgctatttctagcggcaagtgagtaaccttgatgttgctattactgctgaatctgagcagccagagtgtgtcaaaggtttctctacattctctcattttaacctcacagcactgctacaggtaggatgagtgggtagcactgtattctacttgtcacacttggggaaatggatcactttcttagctatcaactttaatgtcctcctgtgaactagaggagtgacctaatttttactgagcaaatgctaaagtgaaaagtactttctgttgccatttcttttgatcttctcaatggcactattgggaaggatttattaactctgattttacagagggaaaaaccaaggctcagtggggttaagtgacttgtccaagattcacatagctctggagtgttcttggaaaacagaaaagaaaatggatatgtttaaatgacaaatggtcttgtctctccacccttttttgtcattttctccattccggaaagttgtcttggccacgttcttttagttcctaggaatttcctttctttcctcccgctggtcctctttgctggcccattatgcctctctaagcggatttgtagtttctagccttgaactatgagtgctcctgccgtggctggctctttattctttaaccatagtagaacaagaaaacccagattctctgaatgattctgattttaaaatgtaagacaagtgattctagatacattttattccactttgtagagtttgttgtggctccatctctaacaaagagaatagcaattcctcctctttatttaaagcatggaggggatctcaagacaatcaattatcagggcctttgaagttcttttcattttacatattttttctgagtccaagtcaatgatccccatggcttcccaattctcctatggtaaaatctggaaactatactatagcattcaaagcccaccatgtccactctcctgtgccttcccctgccacatgtgataccataagactatttgtttcttgtgctccatctccaatggccttcctttcatttcctaaacactccaagctccttccttctacaaggtctttgcatagtttctgcctgaaaacttcttaacagctttctggttcataatctactcattatcttaattgatggtgacttcctcaaggaagtattttctagcccctagagtagtttgggctattatatgtgttccgtagtaccatgtatcataccatgcaaattgttatttatattgtaattaattgattaatatctatttcattcactggatgataaacctcataataatagaggccaagtctgcttttgcaaaccattgtggtctaagtaactgggacttaggtgctcgataagcatctgttgaaagtttgaatgaatgctctggattatattatgggtgactaaattgccatctgaattgttctgatccaggtgccgaggactcacttttgttagaatttaaactgatacctggccagttgtggtggctcgtacccaaaatcccagcactttgggaggccgaggtgagctgattgcctgagcacaggagtttgagactagcctgggcaacatgaaaaaaccctgtctctacaaaaaaatacaaaaattaactgggcatggtggtacatgcctggagtcccagctactcaggaggctgaggtgggaggattgtttgagcctgggaggcagaggttgcagtaagtggagattgcaccatggcactccagcctggatgacagacaccctgtcaaaaaaaaaaaaaaaaaagaaaaaaaaaagaaaagaatttaaacttatacctcatgagagtagagagcatgattatacttgatatagatttctttgaatcaaaggagtttaaattgtatcttcttaatatggatctcttcgtattcccatcagttccgaactctgtatttaatacaaaatcttgcaggattcatgtttagttcagagatccaaaataatatgggattaatttatgctttttaaagacagttggccagtagaaagtaaatgttaacagagaaagcatttagggaattagagtagtatagtggttataagtccgagttctagcatgagacttttttagataaaattctgcttaataggcatgtgatttggtgcaaaatatttagttgccctcttagtctgttttctcacttgtataatagaagtaataacggaaacttcctcataaagttgaaaaggcttaaacaaggtaagctaggcaaagtgcatagcatagtgctgggcatcaaggaagtgcccccaaatgttcttatataattaagagattaatacattatcaagttatttaagaattaatcaatgttaattgacttgctttggctttcctccccaaatcacacaactagtttccctttgtaacatttggtgaggtagccattgttagaaagtcatgatttgagatgacatctagacattcattgagaatctggatacagaatatggaagaacattaaaatctttgacaggaaacatgcaagtagattgttttaaggaaagaaaacaagatgatgactctacattcttctcgatgatcttcacgtgattctaattctctttggcaacaatagaaacatttattgtaatcatttttaaaaatcacaaacactcccacattatttctggtacttatggtaaccttatcacctttcctagagcagagtaaaggcaggcattctgacatttggaaaaatgaggtgtgtggttatttttagacttactgaaacagcagcagcaggcttccatttataggaactgtaggaaccttcccctatgtctgggacaaggtaatgacttctatgaagtaatgattttgccatcataaattttatcccactgatgatcaactacctctttagtggcctttgcattatgctagtttgtctttttagtattaagagaatgaggccctggttgttctttgcattttatcatttctttcttcccgggctgggagaaaatgagaagcaggggcagactacctcatgactaaattgttcctggctaataaaactgcaggaactgtacgttagggtgtcttccataaatcagccttggggagaattaggtgctgagagatggaggaatgatgtttaatcatcacttgtaggaaatcattagctccacacccgcattctcctacttgcccattcgtcattccccaatccctagattcccctagaccattaacatttctcaatgactttctaaatgcagagaaaaaccacagaaggggtgagggatggaggtgcattacggaaaaacacaacagagagatgtctttgctgcttgcttcctgctcctgtgaatgtaaatggacctatgtaaaaaccaaatgatcgataacttggccagccagctgctgccacaagaggtaaagaaactgttgcctcctgttttcccctctgcaaaaagaaataacttggttcccacctagatttctttcctttggcagtgtgaaagacagctctttcttttcttcattatcataacttcctgacagataaggaaagtgaggacgttggctggttcttggaggagtaccaactttgggaaattaattgtgtcttcctaaactgccctctgtcccaccctagagaggaaaagccacaacttaagtttctgtaaggtctacaaaaaagtgaagtggacagttcagtaaaactgaactggttcatggtctaaatgcattggtaagcacccttaaaagggttaatccaatagcgatgtgtagacagacagatctgttcagcaattcatagagggaaacagtattctagccttgccttctccaagaatatacttgttgatgctaatacatgtacacaaagggattttaggagcctcttccttagacaagtaccccaggtttttgcctctgattacttccggaattaattttgatcatggatcttagacactcttagctttcatatactgttttccaggcaagactagaaggtcaggaatacaataacaagttcattgagaacttactgtatgccaagcactgactctaacaagaaacctgacatatacaaaaaatggctaatttgcaccactgcactccaaagtaaggatttaattttactggtgaaaaacctagtgctagtgattgtgtttctgaattcatgcagctgagacaaggcagatctaagttctgtaggtcctgaaagttacttgaatagcctgtatgaaaaatgcgggaatacaaatgtaggtacagggatacagaaagggcatgtgaaagggagggtcactgtagctgaatcttcatcagctctgtggtaaatttgcttccattcagttagaagcagaagaagctgatctgactctggtctccctgatatctcaactgcaatgaaatttggcatataaaaaagaggagtgtctgttcataatcatttgtgcactttttaatggggttgtttcgtgttttaattgtaaatttgcttaagttccttgtagattctggttattagacctttgtcaaatggatagattgcaatatttctctcccattctctgtaggttgtgtttttgctctgatgatagctttttttgctgtgcagaagcgctttagtttaataacatcacatttgtcaatttttgcttttgttgcaattggttttggcaatttcatcataaaatctttgcccatgcctatgtactgaatggtattgcctagattttcttctagggtttttatagttttgggttttacgtttaagtctttaatccatcttgagttaatgtggcacatatacaccatggaatactatgcagccataaaaaggaatgagattatgtcatttgcagggacatggatgaagctggaagccattatcctcagcaaactaacacaggaacagaaaaccaaacactgcatattctaacttataagtgggagctgaacaatgagaacacatagacacaaggaggggaacatcacacagtggggcctgttgggggaggttggtgggaggagagcattagggaaaagagctaattcatgctgggcttaatacctaggtgacaggttgacaggtgcagtaaaccaccatggcacatgtttacctatgtaacaaacctccacatcctgcacatgtaccccagaacttaaaaaaataaaaaataccccctgccccctgcaaaagatgagcgtcctaacaagttgaatccaaatgtgaaatagtaaagagtcatgttaatatcccaatagactttgaggcagcagttttggaaagcttaagagaaggtgaaaaattaatcatggagttttctttgtggctcaggaatttattactccttactataaagctctgagggaagaagccctgactggtaggctctcaaccactctacaaaggagccaatccatggagaaggcataggaaatgggggtcagaaggactgtatcctagccctggtgctagtgctgataaaccctgtgactttagagaagttacatttggtttctttatctctgaaaacagagggctttactgtagcttctgaattctttgattccaactcaaagaatgcattattttctacctatccttggtgttcctccttgtggaatatttgtgggatagttgagtgtgttgtaaagaggccacctccaagagaagtgtggaagtgaagagagaagagaaaatattgctttgcctcgggtgggtagagacagaaacagagaagggaaaacaccatagcactgtgctaaaatagagtccaatgtctatcacacacaattcaggttgcttaattttgtgtaaatgaaaagctaggttgaatagcagaagatgtgagcagttgctgatcacgtgatgtttggagttgcattactgtaagtgcatttttgttccaaatcacactcctttacctagtctccactgaccacaaggatgacaacaacaacaaaaactataacaataatactatagatatgtattgactgtaagatttatgacttatgcacatggacactcagaagatggctcatgtaggcaatctctcaaatattttccaatagagaaaatgttttagattatttgtgggttctcaggatgtatcactaaagaactatttaactcacaaagtggctgagaatattgtatcctcaatgaattgcagtagaaaatgttgataatttgttctcaacaaattaggaaaaaaattacaaaaattatactcactttagtgaaaaaaacacatatttaaagatgatggggagatagatgatggggcagatattcttttatgaatatctgggagagctataggacttcagagattgtggttcccgattgcttgtcattatttgactttaaatctaggatgttccttttatgttgaaggagttgaatgcctaacacagctctcacctttattggccaagattattgtcacttgtcaatcataggaaatgggaatcagaaggactgtgtcctagccctggcactgttgctgatgaacctgtgacttcagacaagttacaattggtttctttagctgtgaaaccagagttttactgtagctttggaattctttgattctaactcaaacagtgcatgattttccacctatctttggtgttccttcttgtggaatatttatggaatagttgagcttattgtaaagagactgcatccaagtgatggaacaggaattctattgtgaatatctggagatacagagatagaataggattgtgggatggaaaaatgaaatgaagtgagggacaagtattttcctgagataattgggtagggaaagcgaagacagacaggttgggtagaagtgaaagaacttttctaatggggaaagacagaaggaaaaacagaagttgctttacctttctgatctctctgaggagaaagtgggttggattagaaagtccagctgccactgcttggaaccattgaaccttacaatatacacgcttccagaaacaaaccagggattgaagggcaggggagataaaggagaaagaagcaagataatacatgtagcagtacagctaagtaccgggtgatacaatgtaagctgtatatgggtacagtgatatgtagtgaaagtttaaaaacaatgacagtatagaagcatgctgttgtcagatggggttattaggaaggcaagataggaatatgataggggtattggccaaagtaattaactgagtgtgtctaatgctctgtgtgggtggatggaagtgtgtttatgtattttaaaaggatctgagacaaatatatcaaatattaacataggttatatctataagatgggcacatgggtgcctattataaatcctgtatactcttacattttaaagttatttgtagggtaaaagtataataaaggcgttgtttatgatctacaagaatattaataatagtgttatagatttgattatcaactctgcaaagacttccctttctaatgtaaatttcttaagcccactttgcctcagatgctaaagttattaggaaacaacatgtccaacttattttataactacgaaatttttaaacatcttgggcgtgaacattaaaatgaattttcatgttaatttgggccacctttgagctgggtgaatgtagattatacagaaatcacttgattaatctctactctaatgaacctatttctagacaatgataaagaatattgatcctctgtaatccattgctctaggatgctttgattctccaggacaggcatttccattgcaggtggatagataggcagagtaggcttgtgttcctaggagaaaccagagggagaagaagcttggaaaaatccattaggtatagtttatgacttgaatgaaacttaactgcttctacaccatgtcacattgcagatccataaggattacatgtgtggttttccatatttgaagatgatacagacccggaagcagagaagcccctgacttgtatttttatgacagtggaaattccctatgttcagtttctttgccttcttccccttgcaaaaaatatgctttttccaacaaataatcattgtgctcctaataagtgcaaccatgacagtcactggagacacagagctatgctagacccagatatgtttgttaaggccctcacagtctagtgaggaaaggaagcaagtcaacagacaactacaatcccaactgacaggctctgctatgagacatttagtgtattatagcgagggcaggaaagggcacccactttgcagctggtgtttcagaagacacatcgtggagaaaggagcatttgcagaggagcagccattgctaagtgaaacagatggggaacacattccacatggtagggacagcatttacgattccctggagctttaagggggagagacgtgacaaaaaaattccaagtacaggcgaaagtctcagtgttctgttgaagtatcttgaggtgaagaatgactagacttcggcttttttttaaaaatttttaaaaacatctctgtcatggcagtgtagatgttatcttattggagtatgaatctgaagaagaaagatacctatggctgggaaataatttataaccaaaggacagataaaacacaacaggattatagggacctgacatgacatatggtggtttcagtagactgagctggaaaaagtctctaggtgttgtctaaaagagggagagctgagcctagtttagtcagcaactattttccttaaagtacctttagctctccatcacccagactggttgtaatttctaatagttaataatagtaataataatcataaccaatatttactgagtgtttactatgtgccctgcatgtttttaataattcacctgcattcactcaactctcacaacagcccagtgagataggttacagtggtgtcccattttacagataaagtagaaggaggtttagtaatttgtccagggtcacacagccagcaaatgagtggagccaagagtcaaacccaagtggtgcagctccagagttcatactctgtctcccagggtgtaccgcctcctagatcaagaccattttatgtttaatgcaatttacaatgtcactccactattttttcttgtaattttatacatgttatttagaatttgtttccttccgaccagacactggtccctttataaaactacttatggtataaatggaggattttgtaggtctaaccctatgtctcagacaagttaataattgatgttatcattaaactcattgataatgaaattattccattcaacgtttttatttcatcctaggcccatcaattacaagaaatacaaaatttatatgaagatagatggtcatataattttttttctattataagggaacaagtcatagtgatttttatttcagtgccaagattcccttattcatccatttgtccatttattcttttgtcatatattgattgagtgtcaactaaatgctggattatggttatgtactagagatactgtcaaaaagacacagttctaaccctcaaaaatctggtcatttgggcctaatcaaatttctgctgtccacaatgaaggaaacagggaaacaagaaataatttttttgaaagaatcccatcttgacaaaataatctacacacacacacacacacccctctgctctgagaattaacaagacaacctacagacgccatttctaaaaatctggctggctggaatagagggaggaactatagctctgacataaagatttagggtaatttagtaaaatattagattaaaatttaagtaggaaatttatgtgttattaaatagtaatcatgtttaagaattaatgatgaggtattcagttgtgtttaatgcttaattcttagctattgcttaaataagtatcaacttttaaaaaacatgattagctatataagtgaagctcagatttttgaatctattttttaaagaatgcaatactgctcagaggtgaaccctgagaatctatggaactagatagcctaaacttaacctccggtcatcactctagtagcaaatgcaggcattctgatcatgtgttcatggcaccagggacagagacgaatgggcctttgtctggtgtcattataaattattctaaaataagtaaagccaagctagggaaagacagactttttccctctttgcttgtttgaatttcactttctctaagaacttcaacattaagaagaactttattattaaatttcttaaataataaatgctgaggaggcatgttacccaaaggatggatttagtttcaggaggtagcaaatatttcagaggcaaacagtcaaagaattctattccttgaactgaaggaaataatatagcatttattgagcttcagttttatatttgttatctcatttgacttatttctttcaacactttcccatggatttattaatattcctatcttatagtagagaaaactgagatttgcttctgaggcttttttctaagatcacacagttcaccagactaagaacagagattttaaaagtcagattttctgatgcgatgaccagaactacttcctcttcttgttgttcttactggtagcattctgtaaagcatgccaccatctctctgataatacaagacatcacaatcgagaagtcaaacaatcttatgttctattcaaatgtgaaaatttgcataactcaacctttttggattttattttccttgattaaaccatgaaaaccgtgagttgagtagaatcagacagagctacacagagatgaaaaaagggccttcttagattgctttcatttatacagaaagaactcatcactgcaaggtgtctgccctgatcatgttgcttcaagccagccatatcctcaatcattgctccacagtgaatctagtcaatgtgggaacattgcattacagctgatgggaatagtcttagaccctgctgatttgctcgcaaattttattcagtctaactttacacctttggcatttttctccaatttagttttactccaaatttctggacacaaacatctccatacccttcccattgcatataacatagtttaacataacataatataacgtaatgtaacgtaacatagcataacatactcataacaacacaacataacattactgctatagcccgcaagcatgatccacccagtctttgattccccttcccaccttatcttataccaccttctgccttgttcactgtcctccagctacactggtctcttattttaaattcttcaaacattttgcatttgctctggtgtaagggtctttgtgcttgctttttatgcttgggatgcctttaccctgacctttgcatgcctcatttcctttaggcacttcaaatttcagcaacgtagggaagcctgacctgacaacctagtgatcaactggctcttggcccacatcaagtcactatctaccacattgcattttctagattttctttatgggagttataaaaattaaaccatatgaaattaactttttaacatgtatagtcgtttattgtttactaattttctgcaatgtaagttccagcaaatcaggggcctcttatatcatattaattgctgtgccttaagggcttacaggaatctctgaaatataataggtaccctttaaaaataatctgtagaatgagtgaatgtttgaagagattagatatttagaacacaatgttgtcagacactgtaaagggtgtgaggtttttaacctacttgctagataacatagacccctgggttagagacaaagacagtttattactcataacaaaagcagtcgccaaaggagcatattgcatcagttgccagtgtccaatccttggatccagtgagggcttgatgggacctgtacatgcaatgggatacattacaggagaggaacccaagattaaagctgttggtgggcttctcattttgagagggagagagagagagacagagaaagagggagagagagagagagagagagaggaaaggagagggaagagatattccatttttattctggaatataagcaaacatttcctgggaaaaggaatgagagttctgtatcttcattatcccaggctatctctaggaaggaagatttctctatgctttactatcctggaatgtatccttatataagtattcttaatttggctataaatgcctttgctcagaggaccgagaccctgtgtaaacatgagatattcatagaaaatgatttctcatcacacagtttccatgtcattgactaaggactctgagttgtatttacttttaccttctgcaagtaatcttgtccaagaactctggaaacctttccattgtccagtttgactgatgccctggcctggccacctgcaggagagcttagacccaaggtatctgagtccaaggacacttgttcattcaccatccccatcgacattggtagcatttgctgttaatggtgactttccttggactttactagcaggtggagtaatacagctcaagttaaataatactcttccagtagcagaagtttgaaatgcaaggctcatttagagacatgtttgggatgagtatattttcctccacctcatctcattgcctcccttttaaagtcacaaatgcaaatctggggagagcttccgagaaaggcagattgaaaggcttaaagatgactgggttctagtgcatatcccagaacaaaggaccagttatataccaagcattaagaagattccgctgggctcctcaacccaatttaaaggctcttactttaatcctttaatactgtatattgactccttacctctgcaataggatgaaaatattctgcccaggttgttccttttcaatagtccctattggttttcttgttcttctttatttcttatttcctttataaatgaaaaactaaacaaaactaaacaaacaaaagcatagacagataatctacatgtatctggcgctatagttagtttatagagatgaataagactgggtcctgctctcatgaagctcactatctagtggaacagatacataaataactatcacagtgcagtggtccctccatggggttgattttgcatccccgcacaggagacatttggcaatgtctggacacggtttttttatcttcatgactgggaaggtagggttggttactaagaacatctactgtgtagaagctacagctgctgctaaacaccttagaattcacaagccagtttcctacaacagaattatttggtccaaaatgtcagtagtgctaagatttagaaaccctacaatagggtaaccaagctgaaccagaaattaagaaagacaccgcaattgcacgatggaggattgagtgtctcaccgaaggatggcagagttggtcagaggagacgtacctgaagaggtgagttttgagctgaactttaaaggacaattaggagttttccaagtagatgtagagggtatcgtaggagcaagctccctcacgggctggggcatggagcattgatttcctgctagagaactttgtgttccccaaggctactgaagaccacagaggagtagtacacaggaagcaactaggattacacagaataataacaacctaccttgttcagacatctactctgtgctaagggcagggaggccagtccttctcaaacctgggcacacagctagattacctatctcagctacactcatagttagatgtggccatgtgactgagtgcagtcctggactattggcaggattgaggtgtccacttccaggcctcactcgtaaaggcatccaatgtgtggtccttgctctctttcctcagccacagtctagaggaactctaaggccctgaggagggaggtgtcaaagatggaaggaagttggtccctgaatcactgcataaaagattacgcaccggacttgactagagcagagactaagttgttatgacattaagctactgagatttcagggtttatctcttatagtagaaagtgctactataattaatctaagtataaatagtgctaggtactttagctacattatccctaatccttttgataatcttgcaatacagatgttattctacatattttaaacataaggaaaaagggttcaaagtagttaagtgacaaaagctattaagtggagtgaatcagggatcaaatgcttgctctttccaatgcgcttaatggtatgtgctttctctttacaagagctagttttgaatgactctggataactttttggagggagagctttcctatacagacttgcattcttctgtatttcttctggtttggtatgggggaaagattacccctaacccccgtatttccatgcctggtttagtataccaatgcagtactctcatcgcctaaaatttttggtccactggtaacatgttcggtaaatagaaactgcacttgcgtaagtggtacattgcttgtcagacattcagggatggataaaaaaaaagaaaaagctttcacaaatgtagttgtctttctccttaattatttttttctccaatgaactggaaaggtacatgaaacaaaggaccattctgcctctcttagctgctggaagccatgttttatttcccagttagagagcctattggcccctaaggctgctggatggggaagttgccagtaggcaggcagagtcattaagggaaatgggtgtttacatatagcagccctgggagatacggaagttcttgtgtggatagaaatgaagtaagggcctgagaggggcagaatgtacatatttgatggggcacttatgaaaaacaagtggaagaacagtgtggctggatctgagagtggaagtataagacatgaggccgggaggtcactgtagtggtctcaggctttcagtctgcccagcatctccttcagcatctccttgggaaaccacctctcctctattattagtctttgaaattaaattggggttgagcaccttctacttcctggtttgggaacctgacccagacttggcccatcacttgatttagtcctcattaccctctgctgatcccagccacagtagctgttatagaaatgagcatattacccaagcagcaccagtataaataatctctaagatgtttctgtgtgggaaacctataagaataacaaatttggaggtgaagtcaagatcatcagtttacattttatttgtggtgtctttgtcacattcatatagaaatttcaattaggcagctggaaagttgagtctaggtttcagagaagagctctggacaggagagaaacattggtaaatcatctgttccttggtggtaattcataagcacacatgagatcacagagtcaaaggttaagagtgagcagagaagagggcctgtggctgggcctgggataatgccaatatttaatggccaaataggaaataaggggtctgaaaatgaagacacagaatggataatcataaaggtaggaggaaatcaaggaggtcattttgtcaactaaggcagaaagaaaatgtttgaagatgttgtaatcagcaatcctgatagctgctgatacgtacaataagctgagaacagagaaatactttgaaattgagcaacatgcatgctattgctgacctttggagctgtttcagtagtgtgatcacagcaaaagccagagggaatgggttaaggagtgactgaagagagaggaaatggagataagttatcataaacaacccttccaaaccagtgaacccttaacgtgcaaaactgagccactggcagctggaagcctgcatgacaaactgtggtttggggttagatttacctggatttttcggaatcaagggtgcacttatgggccttgattcttgattcttggctttttgtccatggttcagttctgttcaaccaacattattgagtatatacattgtgttaggccctgagttgtagggaagaacagaatttggttcttggctttgagaaacgaactatccaggtggggaaaaagacttgcaaaaagaatatttgaattcaacatggtaatgcagtgatggggtacggaggaggcactcctgagtggaagaggtgtgatagctgaaccaagcctcgaaggatatgtagggtttaagtttctctctccggaaatctaactcttccacatatggagccaacccatagaaagtggatgtcaatacatacgtatacatgtgccatgttggtgtgctgcacccattaactagtcatttaacattaggtatatctcctaatgctatccctcccccctccccccaccccacaacaggccctggtgtgtgatgttccccttactgtgtccatgtgttctcattgttcaattcccacctatgagtgagaacatgtggtgtttggttttttgttgaacatgtaccctaaaacttaaagtataataataaaaaaagaaagtggatgtcaatacaattagccttcatgcactcagtggaataaatgtgcagagaagcagaagcctgtttctttagacccctgatgctgtccacctaccactagttggctctgtatccactgaaaaagaaaaaagcagagcagctaggtgtgtatggaaaagaatctctcctagatttcttatctccatggggtttcagaatgaaatataccagctccacaggaaagcctctgacagatgggaacctatttaacaagccatgggaaatgaataggctggctctgagagggatagcacagccatataaatctattctcagggatgtgggtgtcggcaagccccaatgacccacattcagaagtatttgtctattaattagggcaggtggttccatcccagaaggctttgcctagcaacagtaaccaagaccatctgcaacttcagtcctgtgagagagcttcaagtgggagaaattagagtgatgtgcacagtagcaagagaagaccgggaacctgagcccgatgctgtattgtgcccctgtttttccctcactgaaatcaggagtttctgacagatcaacacagtccttaaaataaaatctttctcccctcactaatttaaaaatctgtatggcttttacatctggcatataattacaatagtggatgatttcaaataagaatattaaacaatgtttaagagttattgcaagatggttgggacatagaaaaaggacaatggagtctttaatacatacttttgttttattcaatttattcgttgagcaaatgtttatttagaatttttcacatattgggggcacaatattgaatgaaacagagtatctgacttcaaaaacttaaaatctatgggaataaatcaataaagtaatttcagtgcaatgagataattactgcaacaggtagctctcagggcaggaagctctaagtacagggagctcctggaagacagaagcagccctatcattgagggctagtggaaagttaagaatgggaggtacagtatgagaaaaattaagatttatattgaggaaaacaaagtatggtgttctgagaagtgctacaatatgtatcaaggccaggagacacaagcagggcatatttcttgaatgaatagttcactgtggcttgggacttagagggctgggatagaagtataagaaatgaagtggagaggaagagaggtaaggagcggctatgacattaagagtctaaaatgccatgctaaggagtgaggatgttgccctttaagtcaccatagaaaagttttaactggaaaggaagcaaactcatgtttgtactttgggaaatgttcatttgtttattcatatcccaaaaaatacacagacaacccctgctctatggcagacattgctttgggaacacagtggtgttcaaaacaggcatgattcctgcccttgcagcacttgtaagacagatgttaaacaaatgatttgaagggtcagtgggatatcaatgtggaacatgaacagaaagaggctagagacagggaggtgacttaaaggcctgtggcgataaaccagacagaaagtgatggtggctcaatccaaggcagatagcagggttgggagtaatagattaattccagatgtggtatagagtgagaaaccctgggacactatgactgaatatatgaagaaaaatgcaaaaggcaattgggatctcctggtgaccatacacttctcttgatgaaatagcatgctcaggattagttcgctccatgaagaaaaaggaaactgctcaaattttgcaaatctattggtgcatcttagagttaaatcctgtggtggtgagagatgacatagaaattcaggcagccttgatatttgaaaagagctgtcaatatctcatactctctgaagaagatcacttggcatggctagtttctgggtggctaacatgaaaaagacttagtacaggttaagattcaaaagtctatttaaaatttatacttggaccttttcttcagccagagctcatgcagtggtaaatacttacatttttaactcatgccagaagattttttccaagctattactatattttatattaaaattgtttacattttatttataaacatttcaaacacataaaaacatttagaaaatattatgacagacacctatgtactcagcaatcaccaatcttaagtaatttttatttaagctgttaaaatacaattaaatcaccatttccatttcatcatccttaacatcttagagaaaagaatcactgtgaagttgataaatagcatcctatatacttctttttctacctttgctagacgtaagtgggtccacaaacaacacatagtttctttagcaatccaacctaaattgtagctgacaatctggtctctgatgattgttcagtggtcatcaatcattttccacctcctcttgttcactcaacatgttgcgcttgagattttcaggttgataaaagtgaactcagtttattcattctaatggctgtatatgctcattgcatagatgatcacagtttacagatccattttctttactgagagacagtacctttctgtcctttgccttgtataaaagttctctatgtcagcaattgagaagcagaattgctgagctacttcctcatcgtaacttggtgatatccatgtagttgccctttgacaatctggaagtgatataatctcatggttgcttttaccttcattttctgattagtgaggttgagctcaacccctcatattttatttatttgtgtttcttccactgtgagtcacttattaatatgctttgtccattttttctattcgttgcttctctttctgttcttttttttcttattgatttgtagaagttcattctgtatcttgagaacttaggcctttgttccagggattgtaatattttcatccagtttgtgacttgtcttttcatttttgtggtttttttttatttatggaaaaaagatttttgctgttgttttgttttgcttttatttgaatggatagcattcctgattcatattttattctctgtgaatcaatggcttagaattatatatatatatgtgtgtgtgtgtgtgtgtgtgtgtgtgtgtgtgtgtgtgagagagagagagaattaaggggaatttgttaataaaacaggtttttttaaaaaatcaacttttagacacgggagtatgtattattttttgctagttttacttaatatgtgttaaaatatgtgatttttcttcattacgtattatgtttcttttgtgctctaagaaattgttcctaaccaaacacaataaggttttttttcttctatacatttttctaaacattttagaggattactgctcacatttaagtattttatctagctgaaattaatttttgcatataggcagaggaaacgttctaattttgtctttttccatatggacagccaattaatggtcccagcaccatcaccagttttataaaaacctacttccattatgtgccaaactctcatatacatgagggggttgtttcttttttccatgttatgttcccttgatttatttcctattcctgcacctgtaccatccaggttaaaatattgacatttcgttaatatttataattacttactggtgaaatacttatttatatattacacaattatattaaaataaaaatattactcatataaattcatactctttctcttgtgcctcccctttccttcttattacagtggcctcttccatctatttttttttccctttacaatatcatcttagtcattatttaattttcagtttccataggaagtttagaatctgcatgtcaaagttcatgaaagatctttttggaattttaactataaccacattcaatttgcagatttatttagggagaattgggatatttatgacattataattaccatccatgtagatatatctgtttttatttataacatttctttttagtcttcaataaaattttacattcaggccaaacatgttttttacatggaaaattttattttgaatatgtttcatcttgaaactaattgtccatttacatttgacaacagccatgttacctcttctgtttttttcttttaatttttatccacatttaacatatataaagataagtgaacaaatcataatagtaagtcttgattacagaggggtcataatcaagaaactgtcacctagacaaagagaaatttttaaaagctaattatcgggggaaattcagccagatatcctgcgaaattcagccagatatcgggcgaagttcacccccaatatttcatgtaggttcttttctatgttccctaagggtcagccggtctgagaaataaaaggacagagtacaaaagagagaaattttaaagctgggtgtccaggggagacatcacatgtcagcaggttccatgatggcccctgagccgtaaaaccagcaagtttttattagtgattttcaaaaggggagggagtgtatgaatagggtgtgggtcacagagatcacgagcttcacaaggtaacagaatatcacaaggcaaatggaggcagggcgagatcacaggaccatgggactgggggcaaaattaaaattgctaatgaagtttcgggcacacaatttcattgataacatcttatcaggagacagggtttgagagcagacaaccagtctgaccaaaatttattaggcaggaatttccttgtcctaataagactgggagtgctacgggagactgcggcttatttcatccctacagcttcgactgtaaaagacggccaccccccgaagcggccatttcagaggcctaccctcagggacgcattctctttctcagggatgttccttgctgagaaaaagaattcagcgatatttctcccatttgcttttgaaagaagagaaatatggctctgttccacctggctcactggcagtcagagtttaaggttatctctcttgctccctgaacattgctgttatcgtgttcttttttcaaggtgcccagatttcatattgttcaaacacacatgctctacaaacaatttgtgcagttaacacaatcatcacatggtcctgaggcaacatacatcctcctcagtttacaaagataatgggattaagagattaaagtaaagacaggcataggaaatcacaaggatattgattggcgaagtgataagtgtccatgaaatcttcacaatttatgttcagagattgcagtaaagacaggcgtaagaaattataaaagtattaatttggggaactaataaatgtctgtgaaatcttcacaatttatgttcttctgccatggcttcagccggtccctcccttccaggttcctgacttcccgcaacagctaaacttgaaagagaatattatgcacatcccagaagtctcctggtgtctccttttgctctttgactcatcacccttcctacggatcgttcactattcttattatcacacatcattgactagtttgtcctcttaaaaatgtgatatgaatgggatgtttgcccttcccaccatgtgaggacacagggagaaggcaccatctgtgaaccaggagacaggcctcaccagacacagaatctgccagtgccttgatcttgaacttctcagtccccagaactctaacaaataactttgttttattcataagctatcaagtttatagcatttggttaaagaggcccacatgcactaagacagtattccattgtgtgaatattatttatccattggaatcatttattccctgaaatctcagtgggcatttggatagtttctagtgggggaccattataaatagggctgctatgaacagtattgtacctgtcttttgatgaaaatatgcatctaattatttgggtataaatttaagtgtgggcttaatgagtcatatggtatatatattcaacttgtagttgatactgccaaagaaatttttagcattgtatggagaattctgatgatccacattaccaaccatttgtatctcttttctttttcactgattttttgtaatggggaaatagtgggattgcattgtggtttaatttccatttttttcagatgactaataaaatagagtattttatttttatattttattaaccatttgagtctcttcttttgtgaagagcctattcaaacttttgttcatcgttgtattgagttgattgtgtttttctgattgagttggaaaagtatgtgttggacacccccccaacacacacacacacacacacacccctacacttttcactcccttgtcagtatgttttatttctgagtctaatgtactataacttatttttcttttaaggctagttctgctcatatcctatttaagaaatctttgcctactctaagatcatgaagctatcctcctatgtgtttttaaacctctattgtcttacctttcacatttaggtctatgatccacttttagttatttctgtatataatatgatgtaaggaacaagacacattttcttgccattgacatcagttggcacaataccatttattaaaaaggccacctttgccttcactgccgtgtcagttttgtcataaatcagatgaccatatgtttcagaaactatccctggattcttttctgttctactgatttatgtttccctttttatctcaatatcacactgtgttcattaatatagatttataacagctctcaatatcttattgggtatgtccttcatgtttattgttctttgatattactttgccttttcttggccatttgcattttcatgtaaaaatttagaatcaacttataaactcccaccaaaagtacattctggatctttattggaatcacctttattggaatcgcattgagtcagtagatcaatttgggggaagatttggaatttgacaacataaaagttttttattctatggctataaaatatctttcaattaattgggtcttctttaacttcttttttttttttttcttttggtgagacagagtctcgctctgtcgcccaggctggagctcagtggcgtgatatcttggctcactgcgacttccacctcccgggttcaagcaattctcctgcctcagtctcaatcccgagtagctgggattacaggcatgtgccaccacacctggctaatttttgtatttttagtagagacgtggtttcaccatgtttgcctgtctgattttgaactcctgacctcaggtgatccacccacctcagcctcccaaagtgctaggattacaggcatgagccactgcacctggaatttaacttcttttaattgtttgaattgctcatttttgaagtttttataatttttattaatttaatttattcctaagtatttaacatgttctgatgttattgtaaatagcaccctttaaaatatttgtatttatttgttaattctgtattatgttcatttctctttgaaataacatagagatgaattttttttcaagttctctctgtcattacctgacatgtttagcccatgtatgttactgatatgtgttaatttattttctccaacagtttatgaattttctacttactatgttttgcctttagttttagctctatatttcctgccttccgtagggttaatcaattttatttattctcacgttcctctttactgttttgaaaagtgcacattatgcctctaattgtttataggtttcccttaatatttcaatgtaacacctcctttgtgggagttgatataagaatttagtagcaaacatgaggcaatgtattctgagtgcatgacccatgacaggtgctcaaaaccagtaattatcattatgaggatttttaggactcttagagatcgttttaagacacaaaaatcatcttttcttaccccactctttgtatatctccctgtgtcactctctacatacctttctaggactaaacagtgacattaaacctatccttaaagaacttttatatctgagtcgtttcattgtaagaagaaaattgagtcactaaaatctccagggatggttaggctaccaaagacaatatagtcaagagtagtggagcctcagcttgaggcttatgagactggaagctgaaacatgttttttccacctcatttacatgtatcttgttaaaagttgactatgatgacactctgatcatctactgggaagaacaagcatgagaggttttgcccatttttttttttaattggccttgttatagctattaacagaatcatggcttttactttttatcgagaagtttctctttgtccttccctcttaatcacaatttatagatcttctggatctgtggcagagttattatagatcttggacttcatagtcttttaatctacaaaaattgtgactcaaaagtcacaatctcaaaacgctactcattcaaatatcagtcctgacacaatctaggaatcaaaaattatatttgtttgttatttctgtattacgtttttatctcttttaaataattagagccttaactctcaaagggccttgactcatttcaaaatctttattattttttaaattttaaggattatttgacaatagtatttataaaacaatgaagagtactattttccatatataatgtctgagtcattatttgactctatgctacctggtagatattatctcccattccaagatatatattattcccttgcaaaagcagacaagacaattcaggtgtaaactctacaggagagacagtaggattttactatttctcatttctaaaatgtgtttgaaatgctatgtaatctgctctaatcttatttgaggaattggaagcaaaatccaaaaataatcatttcctacttttgtgtgcgttcttgaaagatatgatgagactggtggttagacacaaaaatatgagtgaaactaatcttggataatactctaacaattgcattaatttttgcttcaagttgatatcagtcaacttaaagttggggcatatcaatcaaattcaggatcgatcaaggtagggataggtggcaatagggaagtaagaaaaatctacatatacttagaaaacatttttataaatgttgagatttgctgaaactttgccttgcaatggtaaagcaaatactttattcttgtgaaggtcagcagtgaaatgttttaagaattaaagacagtggggccatttttgttaaatttgacaagccccaaagctaactactttctatgtcaacgtctgattgaagggaaattagctttaacttgcactaaccaaattctttggccacttttccttgtttgtttgttttaagtgatgtttcatctctccagtgacatgtataattagttaaaaggctgagaaaaacagttgcatcccagaggaatccatatccatgaaattgttttactccttccaagttgcttatgctttccagttgttataagaagttattccaccaaatgaaattgctattttaattgttaccccctgctttccatgtccccggtactgcctttcccttcttgttaatccatttagatgcatgtttattcttctaccacgagtcctaagaataagttctggtcctctattctgttttctttctcatcttctactaaagacatgcatctgttctgtaattaatgttatcagctactatggaatttcctaatctctggggatctccagaaagtctgttgtttaaagcaaactttttcactcatttttaccctttctttttctttgggaatagaaatggtcttctttttcttcacagcacaagaacaggaagaatgtgtggtctatgtgtccaagaatgtcttcccatcatggtagagtggtcctgtctccaaggtgcaggactccctgccattggctttctttgcatcactatttgaaaattataattagaggaacacactgtgaggttctttgggactctaacccatttttatttgtatttttttgagacagagtctcactccgtcacccaggctggagtgcagaggcacagtctcagctcactgcagcctccacctcctgggttcaagagattctcctgtctcagcctcccaagtatctgggattacaggtgcatgccaccacacctggctaattgtttgtatttttagtagagatggggtttcaccatgtcagccaggctggtctcgaattcctgacctcaggtgatttgcccaccttggcctcccaaagtgctgggattacaggcgtgagccaccatgccttgcccccacttttcttaaaaaaattttaaactgctggtttagaggaggaatggtgttggagtagaagtaagaacatggattttgaggtcagagtgacgtgagattaaatccctgccctaatgtttacttactgtgcaattttgcacaatctcttaacctcagttccctgtctgtaatatgtgaataataataatacttgctataaaggagtgttgttaattttaaatgagataacttatatagtatttaggacagagctggcacatcataagctcttagtgccatgttaaatattaataatgatattaataatgttggagcatagaaagtcctgttccccacagaggcaacctactgatggaattcaggaaaaatatagccagaaagataatttgctttgtgaactggtcgaatgaaaacaggagacgtggttatgcaaattccagaaataatagccaacatttatttcagcttgccagagcatattctctgccccactggttttcggattttactgtgaataaaaatccctgggtagctcgttatgaatgcagagacccaggttctatccttagagattttagtttatttgcccttgggttcatgattctgctttctagggagtaccccaggtgtcttcattaactatatattaaaaactgctgtactgggctttgattcaggctgaccctattgcttgataaagcttacttttcttatacagtttcccaccactctctgagccacagttcagaggtaactgtggcttctactgcgttataaattatccatagagacaggttagtcagactgccttggcctatagaatactctaaaatacaatagtgctcagtagctatagcccgagttcctacaaggcattaggttctttctagtttatagctcattggtgaaatggagtttgacgtcattggaacagataatctttgtactactatctttgcaacttttctataaatcaagttattcaaaataagattattaaaaaaaaattagctcgtaagttcgtattttctcaagtgccttttcaagcacggtattacaaataatagtaataattatcagtataaattaagaggaaggctgtactttctcgggcaaattcttacaatgaatgcaaatgaattggtgttactgcagaggaaacctcacttcctaaggtgcactctctgccctttccatccctgaagctaaggaggaataggagaaaggagagccagggcacagctgtagggagcacatccagatagcacttagtaaggggcttaagtgtctgggtaggaggtgcagggagagaatcaaggggaagcatggtcaaggtcagtgtttggaaaatctggctgaccgtcggaatcctttaggactttttctgattcaaaaggtctgggaagaggcacagagatctgcgggttcttttttttttttttttttgtttttgtttttttgagatggagtgttgctctgtcacccaggctacagtgtagtggtgtgatctctgttcactgcaacctccacctcccaggttcaagcgatcctcctgcctcagcctcccaagtagctaggactacaggcgcacatcaccactaatttttgtatttttagtagagacggggtttcaccatattggtcaggctggtctcgaactcctggcctcaggcgatccacccgccttggccccccgaagtgctgggattacaggcatgagccaccatgctcggcccgagatgtgcgtgttttaaagggtcagtagtgattatgatgagcaatccagtttggaaaacacagatatcagcaatgaagcagaagttaggagaaaatcacaagaaataaatcaggtaatcgaaccccaagagaactgagttatagggcaactgagtagtcagagagctctttctagtggggtacagagggtaagagctagtgtctagttacagaaactcaaacaggagagctgggactacatcagaggcagaaactatgactggagatgggaagtgattttagtgttctaggttagtgctggtgacataggatataggagtgtatcaggtagtttgtgtacaaacacccactgggtaaatagttgtgaagggatttggcttcttttcagagactttttggttttctggattttttttgaaagtttttctggattattttattttattattattatactttaagttttagggtacatgtgcacagtgtgcaggttagttagatatgtatacacgtgccatgctggtgtgctgcacccattaactcgtcatttagcattaggtatatctcctaaagctatccctcccccttcccccgaccccacaacagtccctagagtgtgatgttcccctgattcttccgggactaacacttgtgtcaaagccttggctctgaaagctcatgactgccaggggctctgggttgtagaaagagagtgtggcaggatatggcttgtgcagtcatcaatacgtacaaaggatattgggtacaattaattttaataaaatatttagggcatatttatgtattaaatacataaaaatataatagacacatacatacttaactaataagctaaatgctaaaatatcacaaataaaatggttatcctctctatacccatgtcagaatccatcttcctctttgcaacctaaaataaccattattctaaatttagcttttaccattttaaggaccatctctctatcatttgttgatacatctcaactttcatgtaattgttgtcatgctttatgaatccttctttcttatttcagcatgtgttcttgagacatatgcatgttgctacatgtagatctagccctttagttttgttgtgttagattagaaacactagaatttatgcatgtgttattaaacactgtgctacatttaacattctcacacctatctccttgtacccttgtactactgttttgccagtatggagagtgtcgagccaaaaggtatgttcatcttctggatgttgccaaattggtctgcaactggtggtaccaatttacactcgtaccaacagtgcatgagatttcttaatgctccacattttgtcaacacttggtggtgtttgcctaattgatgttgtttgaagggttattactgattcttttgtactaatcaaatatttaatgggtattctttgattgttttttaaatgaatttgtatatatttaatacataatgtttatatatatatatactgaaatgattactacagtcaagcaaactaacatatccacaacatatccataaccttccatagttacccatttttatgtgtatatgtgtggtgagagcacctaaaatctattaacaaattttcagtatgcaatacagtattattaactatagttttcatgctgtacattagatctctagacttattcatcctacatactctagacttactcattctatgtaactgcaaatttgtacccttaaatctatatcctctcattttcctcccctcccctaccctagtaattgctgttctagtctctgtttccatgtattcaactttttctttagactccacatataagtgaaatcatgcagtatttttatctgggtctagcttttttcccttagcatgtcgtcttccagattcattcataaatgtcaggatcttcttttttaatgctggataatgttcctttgtatacatatgtatgtggacactttggttgtttccatattttgcctaatatgaatagtcctccaatgaacatgacagcacagatatatttttgaggttcttattgcatgtcttttggggatatgtccagcagagagattgctgggtcatatggataatttgcatttttctcaattactaccgagtttgtggtcacttaggtttcttcttccaagaatgttttatcaatacttacatcttttttttcttctttgaatttttgatttttttaaatgttgatttcaaagagtctatatattttgaacactaattcttgctatttaattgcattgaaaataagttccatgaaactgtggtgcatctttttgaaggccaccttcttgaacataagaaagtcaagtaagggaacaaagaaatgtacatcaactttttataaagtagaaggatgaggaaatgggagatgctggccagttgctaaggccggagggaaaagaacaggatctagaagttgatggagtttgaggtagtggctctgcacggtgcccactgaggccaagcccttggaaggacttagatgctttctttggtctcttgcttgtgagcttgagcagacctattaccacagaacaaaatatgaataaagtaaagaatacatagcctggttgttattttatttagcagattcctagtaaacacatactatatgccaggctgtgtaccaagttgctagtattatacacatgaagatgacacagaacttgaccttcaagagatttcaggattgttaaaagactcatctctaatgaagtcactgcaagaaaatgtggtaagagttttaatagcactaagtacgggacaatattggagccattgatttcttcatttgtaaaatacttatagaacatctactatggggtctagggatatagcagtgaacaagagaagcaagacctcctggagcatatattttaaagatgcgagacggtcataggcaattagtaaataaacatacaaaatcacggccataaattagtgatcattaaatatgtttataagtaacataattcagacagtgacaaatgttgtgctgaacagttttataaggataatgtcatgaaaagtgttgaggaatggatctgcatccagcatggtcgaaggcctctctaaggtacaaacatttgagtgagctatatgtgatgagaaagaatcagacgtacaaaattcagaagaatatcacagaccaaaaaaaagcaagtgcaaagtgcaaggctccaaggcaggcataagattggggttcacagataagcacaaatcatagaaaaagaagtaatgggatctgctggcaggcagtagggtttcaggttaaaggcaagctttgcagagtagatcacactgcaaaatctggaaggatggagaataagctaaagaaccttctagctagaggaaataacatgtgcaaggtcaaagcttttgcatctaaatccattactgtgtctaattacagagtcagaaataaggtcctacaagccactgcctgcaatgtttcatgatgtctgggctcagcccaattgcctgtacacttgtgctcctaatctggagtcccaacacttccataggctccattgttaggcaaggaatatcacatcatgcaacaatgaaatatgttttcccccagggaagtagcataatgcagactcggattatcaattggagttaagagggtgagatagagatcatctgagacaagtttcagccaaattcccatcaccgcagcttgtactttggctttggtagttgctgccaggttgtttaaatttttctttgctggaaatttcatgtgagtttatagatgatcccattgagggggacaaacagctgaatacaaatggacttgattccaccctcttggaaagctaagggggaggtgagtaatgagcctttaaattatacctcctggccaatgatccaggtctaagtaaaactgcaatccagccccggccaacctggattgccacagtgcccatttcagtggctctcaatcctcactcactccagagagtggtttgaaacacgtgtaagttttagcagtctttgtgatacttagagaccccctatgtttttgaaagagtaggggaatgttcacttgaccaagtgagtgcttctgatgatagggagcataagatatctcacccttgcctggggctagccctggtaagtcttatcaaatttatctgtatgactctcaatttggcttagatggctccaatcatttgaattgtttctggtgatgaaaatagtcaccaggagactaggaaactccaccgtcagtaacatatacactgtcatccttgatttccactacttttgctttctcttatctgatttcttaaaactcagcagtattataagggtgtttttgttgttatttgtaacatgatgatgcattctcattacttatttctcatcccaggatctgaaaaactttctgaagaaggtacacagagctgcattttgcacttggcaaccattttctaatcacaaagcccacagaaagaaacttcaggtgaggaaagtactgtgtttctccagaaaaaagacattctagatgttatttcatcaaggcatttgggtaacattatcaacctgaggaaaggaacttgtgtggcatattaacttcaccagctgaatagaaaggaagccatgggtatatttttgtccttcaaacacacacacacacacacacacacgcatgcacgcacgcacacacacacacacagtcctgtatctttttttaaaaaaactttctctccccactctcacacacctctatcttaataggtgtttgagcttcctcagagcttggtgggcatcactataggacctgcaagctagtgccctgtggcaaacttgctatttgaacctcttttctagaatactgagatatagatgatgaccatttggtctcttagtttagggttcctatggttttttaatgtattttatgggaaatgatttccattggaatactaatagggtagcagcatgaaacatgtaatggaatctaggaatttagcaacttactctcaggactgctccctcttcatcttgtgtgcctaaaagtccctcctgtcatagacattcactatactttcaatttaattcaacaagcatttagaaaatgtataacagttctatgtggtagcagctcctggaacacaccgtatggcttctgtaaccaccaagaagcagttgcatgaaagaagttgtaatcagtcccaaacactaaaacaagaataataataagttgtaaaatctacagacaaaataaccaaaataatccatgtagcagatgacaggaaggggaaagatcaatctttgtcagaattttcagaactgtcagatgatcaacaagtaagagatagcattggaagatagatgatatttggaaagatatgaaaatccagtctttagactgagatcacatccttaatctggaaaacacacgaacgtaaaatgatttgccacagtggatgaatcctcccagttagttaccattagattggatgacctggtcactttagtaagctacttaggtctgaagataagtttcccaataaggcttaggctaaactttctgagtagtatataccaaatgtagatagtattatatatgaatctcagtacttccatttattatttgtatgactttgaataagtattgaaactccatgagttttcacttttgcctgttacggatgcactgtagtttgcatgatcatttcagaattaaaacaagtaattcacctcacccatagcaggtgctcggtaaatgcccacctgtatccttaggcaggaaagctggccacaatggcctcagtctttttcaagctcagtactccttagggaagtaaagtcagctggaactcagacacagaaatgttgcctaccttcacattgcttttctacaagctaatgtcattgaaactctcttggatacctcagtttcttgggtatctaaatctttaatccaaacagcagtcattgaatcttttcctctgatctttgcaatagtatcagctgaattctgaactcatctttccttgttttttatatatatatatatatatatattttgagacagagtcttgctctgtcatccagactggagtgcagtggtgtaatcttggctcaccacaacccccgcttcccaggttcaagcaattctcatgccttagcctctggagtagctgggattaaaggtgtgtgccaccacacctggctaattttttattgttagtagagacagggttttgccatgttggccaggctggtcttgaactcctggcctcaagtgatctgcccacttcggcctcctaatgctctgggattacaggcatgagccactgcaccggcctgttttatgtagtttctaacacaattccttgcctcaacatatatttgattttataagtttaacattgtatgattctatatctaactccagtgcccacacttattctgaagtaggcctgtcctaactttcaataccatatactatgtacagctgtcccttaagcattagaacagagtactttacttttgctctgcatcagaattccatggggtgtttgttcagtgcctttcttctctagtccccttcttcctttcatgttctaatttgattaatctgggtagattctagaataatttgtttattagcaaggagtactctagtaattctgatataacctgttcattgtctagtatttggaaagtgtcattccaaatactagacagcaaagatgtcaagcaaggaatgaacatggtctgtttagcatggaagttattgagagtggcctgtaagatttttattgggagtttcatatgagttatgtgaataacttgggttcatattatgaagaaatttgttggagagaataaagtggttaaatagactttgaaatcattacccatccacccagacctagttctacctggcctgcacctttaaaataattcttttaaaatttaacaatattagcggggtgtggtggctcattcctgtaattccagcactttgggaggccgagatgggaggattgcttgatcccaggagctcaggaccagcctggacaacatggcaaaaccccatctctatttttttaaaaatataagagaaaagagaaaacaattaacaatatccagaaattatgacaaaaggttagagaagtcaaagctatatctccatgattcccagtaatattatcaacaaaaatatagatatttgtctcttccattgtcaagtcagtcccattctatacatattttagaactacacaggtatttgcacttttgtgcctcttgataacttaaaaaaattagaccatagttaaaaaaaatagtaaccgtagttaatatttttaaatttaacgccatcctcaaggtacagaaaggagcctatagaatttcccattctttttaaaaatggtaacaaaaattttcatgataaaacatttattatgggagttagaaaagcaccatagactatcattcatccatctgcctccttcctcccaatacacatactttagatatgagaaatctgatgctcaaagaatggattaacttgaccaaaagaatatttagggaagactggcataactctagacatatgaaccagtgaaatagaattgataatccagatataaacccatacatctatggtcaattgattttggacaagagttccaagatcattcagtagggaaagaatagtcttcaacaaatggttcaagacaacttgcaaaagaatgaatttggaccttacctcacaccatttacaaaaattaagacaaaatgaatcatagacctaagagtgaaaactatatatctcttagaagaaaacataggcaaaaatcttcatgacattatatttcacaatttgtttttaaaatatgatagcagaagcacaagtgacaaaagaaaacagataacttggactttatcaaaattaaaaacttttgtttatcaaaggaaactatcaagaaagtaaaaagacaactcacaaaatggaagaaaatatttgcaaatcatacgtctgataacggtctagtatccagaatatacattcaacaacaaaaagacaaacaacccaattaaaaattacgaaagtcttgagtagactttttccaaagaagatgcacacatggtcaacaagtatatgaaaagatgttcaccatcactggtcattagagaaatgcaaattaaaacaacaatgagataccactgaatgcacattaagatgaccataataaaaaatatggaaagtaaccagcgttggtgaggctacagagaaactggaaacttaatacattgctggtgcaaatgaaaatggtgtatccactttggaaagaagtttggcagttcctcaaacagttaaacataaaattaccacatgacacagcaattccactcctagaaatatacccaaggaatggaaaacatatgttcaaacaaaacttgtacagaaatattcataacagtactatttgcaatagccaagcagtgaaaacaactgaaatgtctatcaactgatgaatggataaataaaaagtggtgtgtctatacaacagaatattattcagtcacataaaggaatgaagtactgatataggctacaacatgggtgaacctcaaaaccattatgctaagtgaaagaagccaatcacagaaggccacagagaagataattctatttttatggaatggccaaaataggcaaatccacagagacagaaagcagattagtgattgccaggggctagctgaaagaggcaatggggagtgattgcttaacgggtactgggtttctccttagagtaatgatgttctagaattagatagtggcggataattgcaaagcattgtgagcgcagtaaaagctactgaattgtacacagtactttacaatgattaaagtggagaactttataatatgtgaattttactttgatgaaacaaaaaaaaaacatgcagggtctcatgtttactgcttctatatcagtgtacttttccccaatccatgttcagtgatattctgaaactggacagcccttagatatatacctcatgactatccatatggcaaaagtaatttgcttatttcttaggtagctggatgaaagtaacattagtctttcagtgctaagcacagtgctgtatacaagcaatggaactgctagttttatattttttctagttatgttgagaaagtcccaaagtggacacaatggactgtgtcatcacatcacagaaagttcctaattagaaggccacccggggggaccagcacctgtcaaaagcaagaaaattgccaaagggggaaaataagagacccagcaccctgggggataatcaattaaacagcttcaggctcagggccatctgctaaagatcagctgaaaaaagtggctatcaaaatttgaaacttagtctccatggctctgagggctacaaggcccagccctggcactttagctgcaattggaatcttcagctttaattgccagatcgtcaatttccattgactatctgctcttgcttggatcccctgcattgtgaaagggagacatggggatagacaaatcattgcctggacggaggctgattggtggagccctgttgtgatatctgacagccgatcttttataaagccttctgggaatgaagaggaggactggaattttgtggaacactcagaaatgctcgtccttgaaataatgtcattgggagcattccctgagggtcccattacctgggatggggagcatgactctgcaattgcttgtttgagacttagatccaatgtgatgttcaggagttcaactctcctatctaagtgacactgcccttcctcatccagcccctcagcacaggcatttgactagtaaaccttgctttctgcttgattttttttttttttgagacggaatttcactcttgtcacccaggctggagtgcaatggcgcgatctcagttcatttcaacctccacctcctgggttcaagcaattctcctgccccagcctcccgagtagctgggaatacaggtgctcgccacaacacccagctaattttttgtatttttagtagagatggagtttcaccatgttggccaggctggtcttaaactcctgacctcaggtgatccacccaccccagccccgcaaagtgctgggattacaggcgtgagccatcctgcctggccggtttctgcttgatcttacagcccagaaggcacacaataagaaagcaccagattgccttcctggagacatggcacctcagtttcactgtgttaggaacccaacacgtgtacatgaggcactcaagactatgcagcagtcttcttacatgtgtcaaccaactaaaagttttaccaactctatgaggcacacattggtacaattatcaccaagttaaaatgcataaacttgggcccagatgaatgaatgcttttctcaaggtcacataaaaaattaactgttggtgtcagcattctcttctcattctttctcatgcaaagaccacatttgttccacctcacactgggaaaagtgaagagatgagttggatgactagacatttgttctgtcagaaaagtaagcattattgggctttgaacataatacactctgtcctttcatttctgtcacaaaggattgtccctaagcctcaaaggacacaagtaaactctctgaaacctgaagtagttggtctcaatctattctttggcatcaagcaagtgcaagggtcaaagataaaaactgtattgcttgcttcttggatgccacagtccgaaatacctctaaccaaatgtaagtcacacccaggacatgacaagaatctttaatagtggcccaagatttagctatggctttggagttctacagtcattcttgctcataccagttagaagctcatgcactctgaaatggctttgtttggttttggagcaatagtcagcaaactatggcacaggatgaaatccagtcctccacttgcttttgtaaataaaacattattagaacatagctacacccatctatttacatatcatctgtagctgcttttgctctacaaggcagagttgactatttgcatcagagactgtttagtccacaaagcgatactgtctggctctttatatgaaaatgttttcaagccctgttttatgaattaggaagaaagggctttctaagtctttctcactacaaagtttatttctcagaatcaaccagaatgaactgtccagggctgaggtagctgtgctgactccaagaggtggtgcagttgtacagaacatggactctgaacattagacaaacctgagttcaaattttaacaactatctggctgtgcactcagaaaagtcacttaactactctgagtttcctcgtctgtgaagtgcccattagaattctgaccttgcaggacctctgaagattaaattgcatgggatatttgtagcaccttgcccagtgtcaggcacatagtagtattcactccgtgatattttatatataattctcaaaggactgcatgcccacataatgaagacctcagttaaactgacattttgtgggtatgcacgctggagctcactatccctgggctgttccagcatgacagattcctctttacatcccagtgataagtgacccacaggaggctgtgtcttcatgctctaagaatagaatggaaaaccacgctcatttcaaaaaaggagcagaaccccctcttatttccctttcctggtttctcttcctcatgccagaacttgttatcctgcaggcatttcaacctgctcactctgagaaataaaaaatgcaccaggcaattgctaattgctgatagctctctccctattgatctctccatttggctcaaacatctcagattactgagtgatcacagttgagataggtcaggacaaagaggccctgcttaaatatttctatggaagaatgacagagtgtctgcaggaaaaaaaggtagaaatgcatttcaagaggcaaggaccttcaagttaagagttttgtaacatatttaaagcatggggcaggggtggtggggaggtgatccatcagcaaaatggaaagggaaggacttggaagaacctgcaaagggaaggaagcccttggaggtggaggccttagaataagatcagaagtttgatatgaggtaaaattacttcttttcttggatatgacctttttgtcaaatggtattctgctaatgtatttgtcagggttttagtttaagcagaaagaaatttattaagggcaattagttacagaatgtcttggaggttcatgcagctaaagcttgggtcctgcccagctgtaagcaatgcagccaggagaaatggccgaccacttggtacagatgttgcaattgaaatcctgaggctgtcactgcagtcccttggtatccattagactgcagaccatagaacagaaattcagtttcaatatctacaggaaaacagaacaaaacaacaaaaacaaccgattccaccacatttatctttgccttcaaaatctcgagtgacagagttggcttggtaacagtcagattacctgtggaactctgactactaaggagtctgggaaatttagactttaactctccagcattaagtgagctgggacacacactacaagggtgttgggatagggttgggtgaatcaatctataatgtctgcatcttaaggattatgtaaacaaattacatgggattattaaaagaatctctttatgttaagagtaccctcaatccctggacattcttagaaatttgaattgagaagactctgctttcctttgttactaagattggttagtaacctattgaatgagccactattctataatagcaatgaactagacactttacctggcataatttatttagttgttttttaacaactatgtttgataaatattatttatttcaactttcctcttggaaactgggaggaagacaaacttagtaacttgtcctgttaatactacatacatgctgggtagtacgtctggatatccaggaccggcaactagatctgctaggttgaggagcccagagtcccatatatttagagagcctgaagaaaccatagtcaggagacaaaatcttcagttgttcgtggtggagtttttgttgttgtcgtttgtccgtttttgattattattgttggaagtgaacctcctgaatgaggagactttgacttaaagatttggggaagaagctggtttgcttgggcagtcttcatttggcattctgaggaaaattaaaataataaatgtatttgcctgaggtgagtattctttttgggaatatccttcgttcaataccagggcatttgattagtgctcagtgtctgggtaggaatcagactccagattcaaagtcctatctagtaagacagttctctctggttccttttgtttgtatctgaatgcaattgtaattttattttattttattttactttattttattttattattattatactttaagttttagggtacatgtgcacaatgtgcaggttagttacatatgtatacatgtgccatgctggtgtgctgcaactgtaattttctagggccacttgttgtgggcagaaatcttcaggcagtttttttctctaacattaaataaatctatccttgatttcttgaaaaatgcatgagcacacagaaattgcccttgcaaggtgtgggcgaatagggtgggtgttaagagatgaatccagactaagcaagtgccaagaggtaacattctcttctttacatgggaataattaatgcacggctataccacatttatttcttaacactccttctcactcattttcagagtagctcatcttatttaaaaaatggcatctgatattgtgacggaattatgtaaaatctagaattcttgctctaaggattcccgcatctccagaaagttggagaaattgaataagtaatttgaatttcacttctatttttttgttgactttggacaaaaaaaagaaaacccccttacatcttcatttgactccacaagccattttgaaattgttagctgaaaagttctagggaattgcatataaaactaatcattaccttgtaatgaaatggttctgcaagttactgcttaataatacttgaagtcatcaaaaagttcaaagattaattaccatgtaactggcagtgtttagattggaaaattaaggctccagcgaagaactgaaaaatatccatataattacccaggtataaaatgcagcttaatacattctggaacccgggcttctcaaaatagcaagtcccttttgagagcgtcaagtggtttttcattatttttcattattctcatttttcatcttacagcagccaatatcatgcttgtttactaataagtaatggccactttccctttagcaaaaaacacctgcaccaccatgaaataattagaaccagatcatttgataggatattattttttttgtcgtagatcctggcaattaaccaacacatcatatttatacatattattttgggacatatttatgagctgtagtttgcaaaaccatgccacaaaactataaaatgtttgaagccatgtaaagagaattatgagttgactaatttatattaggatagttttgtatttgtgtttttgtatttgtgttttttctcctttccatatccttgcaaatagtacatcttagaagacaagtgagaaaaaaggcccagaatttcctttaaagagattctaggacagaaggaatccagaaatatggaacctaggaatccttcttccataagtctatttggtgttctacactttccctaatttatttccaagtacctttctcactttgcataactggtttacaaatttggcttagaaaactggcccttatgttttcaggagatttttaaaagtaagacataatttaaaaattaaatatggcaagcagtgctaagttcaagcatgagccatatgctagcaagcaaccaccacctggcaagttcattgcagaacagttttgggatgctgtatatcctgtttgaaaatatttgctttaatatttcctacctgaagaaaagaaggtcacttacaaaggtagaaatagagaataaagaaatggagactggcccaaaaaagagaactaagctatctgattgaagacaatgacttgttatcagaagcagcagttgctgagttaggttatagagaaggtgacattttaaggggtgagatgcatgaaatatcaactaaagattagtgttaggaaacttttttttaaagcaaatttctccaacaaaaggtcgttgagtttgaaataggtgtctcttcttagcacatctttgccttcagacaaaaaaactcgaacttacatgtataacacttttttatggcccatcctcaaaatgatccttacattcaccatcttacagcttcaaacgttgccttttcctgtagtagcaaccatcatggttcctttagttcttttaagtttttcttctgaattctatcagggagtaaaactctttcttggcaaatgttggggagaagcagaaaagagaatatgcatgttttttcttggcttataactgttgatgattacatctatctatctatctatctatctatctatctatctatctatctatattaaagccttcttaaaagcccctcagaaacttactcatcccattctcttctgtgcctgctacttactgtgttgcttcatgatgagagacttctagtttattaatattttacctgcccatggaccctggttctcactcatgttacatcacactttatttccgtttgtgggatattacctacttcaatgaagtctcataaaggaagatactacattcccaagaacgtctcttggcatatatctgtctgtatctgtgtgtatctctataacttatctatctagatctgtttaaccttcaacatagagataactatatctagattctttttaactttaacatggagatctctccatcatggtacagatttagatgctaccagtacattttacatgaagatttggtggagttattattaaaccagttggaatgccctgggagaaaagcaagtactagtaaatagaaaagatcattgctgtggttattacatgtgccctctggagagagctgcagaggaacctggagctctcagagacttaaagggaatgggagtcagaatctggtcagtttatgctaaagatgagaaatgatcaagccctgacaacaacttatggatgctattatacttgggaagaattaaactttatatcctttggagactaaacagctccctagatggtgggaataaatcttgaaaacatttttgatgatagttagggatttaaatttgccgagttctttttgtggctatacagggagactaagtttatgagtctcactgaatgattccatatacagaaacagtgggcagcattttatttttcaagtttgactcatcagctctcaactttgaattatatttttttagactttatattattattcccattttcaaatgagccagatgctttctaatgaggttttcattttttttttcagttttcagtaattgcattgtagtattcttgatggcagggaatatgtctacctgattcaccattgtaaccccagttcctatcacagagcctggcacttgcaagggactcaaatatttcttacctgattcatttccagtggacaaatgttcaagttccaccatgcacctgttcctcaaatcacaaagtagaaccatgttgcaatgctggagagcccaatgcggtaatataattctaccctctttatttttagtctagcatatacttaatatgtaatgtagtaaatatgttaacacgtaaaaacacatcgagattcagattctatatctaaggggaagctgggaatatgcatatcattgtttctgacctcacagtctagtaattgagggacacacaaacaaacatgaaatctcaatattgtgctataaatgcaattcatggagctactgaacataaaggtgaggtaaaggtgagctataagtatttgtggtcagacagacctgcatttaaactgaacctcagtcatccactaattactttacgttgcaattgtcccttaacctttctttgctccaatttctttatctacaaaaggaagataataagacactcagtatagaactgtcataagcttttcatgacgtaagataggtaagaagcaaatcactatgtgtgacccattatttggactgctattaaccattactccaaaaatcagagaaattttcctaaggaagtgagggttcttttgtatttaccttgttggaaacagcatccaaatgaggggccatagtatggtgaagaatttagatttgtttcataaggagcatcatgtatagcactgacatgttttggctctgtgtctccgctgaaatcttatcttgaattctaatcctcatgtgtcaagggagggaggtgattggatcatgggggttgtttctcccgtgctgttcttgtgataggagtgagttctcatgagatctgatggttttacaagcatctggcatttcccttgctcatgctcttctctctccttctgccatgtgaagaaagtccttgcttccccttcaccttctgccatgattgtaagtttccctgaggcctccccagccatgtggaagtgtgagtcaattaaacctcttccctttataaattacccagtcttagttatttctttatagcagtgtgaaaacagactagtacaaacactaatatgtatatcaattagtatttatcctgcctcgtttcagaaacggtaagagtcaactctggcatctcatgagtgatccatttaaattatatcaggttatttgcatctctccttgagttgtacctaatcttatggtgatttggaatctcctaaatggtgtggcaatattgctgttgcttcttggtaaggacaaaattcatcctaaaagtcttgaaggaaagagactgggaaagatatagtgcagtggtcctcaaccaggactgactgtggtgtgtaagagacatttgacaatgtctgggaacattttgggttgtcacaacttggggcaggggtggaggatgcttctggtatctgttgggtagagatcagagatgctgctgaagatcctacaattcacaggtcagcccctcgcaataaagaattacttggctcattgtatcagtagtggtgtagctaattaaccttggcatagggaaagacaatatggactagtgcttataacaagtctgttatccaatggtttggtgagtagatttcaggaaaagagacatgaaaaaaaccaacccctaagaaagccaagtacaggctagaagacaaagggatcatgggaagtgacagaaattccagccctttagtatttaacattaagagtaaatatgaaaggagtgggaagaagcaccataaatttcattggaattcatttaaacattcgtgaatctgagaaagggggaaggagacttccatctgttaagtgcatgttctctgacaagcttttgacatatctcaggttaattgtcattagaaaaggcttcaggtgagtagtattactgactgttgagaaatttgggttcttaaacatacagctggttaatgacagaatcagaactcaatacagaactttctgaagtgtttctaattcaccatattttctccttagctggttctctgtttcaagccaatggtggaggcagaaacacaacaaaaaaacccaaatcaaaaataataacaacaacaaatctggcctcaggaaaaatgcaaaatggaaggaagcgaagccaaatatgaatgctacgcatgtgtcttgattgcaatttaatgtgatcctaaactaagcaatgccagttctcttggctctggcccaagacacacctcaaaaacctgggtcatactgttttttcttgcacagaaatagctatatcactattcttggggaaggtataatgagggatgggaaaggctatatgaagcagtaggtggagtgtgaggccctgagtttttatgtctgcatagaaggaaagccacagaggattttaatgtctaaataccaaagtttctttggaagaattattttccaaactcactttccacaaagaaaagaagcatcggtggccagaaaccatggaatataaaccaagagctcaaagctaaggtaggaaaagtttagattagccaataagggagatgctgtttagacagagccatcggggagtgagcagggtcccgtgggaaaggctgaaggactcccagtgccaagtttctagtgcatattggataaaataattgcaaaggactcaagtggtcttttctggccccaggagataattggttagctgagcagagctgtctcacccatgggccaatgacaaattatatcaatccattattttttcaagaaggagaaaagagggttttttctttttttttttcctattgctcaaaataaattttgtctgtaaggagcatcagacaaatagaccctagaggccgaagttttttattaacacacatatagtgacttaactgagcaagagtggtgcaaaagtctcctctgtgaattgttccagcacgccacaagactttctgcaagagccttgttcctctgcccactctgcccgctgcccaacactgccacttggtgtgagatgagagttcctcagtactgccaaccactcagcatctagccctctctgctgagccttccaacaagggagctaataaaaatgtgtagggctctgtgctgtagacatgtgcacaataggaagagggttagaaacatatctcagagtgtacaagattacgaattgtttggaatgatttttagctattctgaagatgtgtggacttaacatagccccttggggttggtgggacatgctcgttgattttctcactgttctctgaaatgcttattttcatgatgtttcatgtgtaaaaagtatttttttccaaaataaaatgctaattttgccccaaatatacaggataggcattgacagtctttctacaaccaactacaacacactcaaccatttactacccagttgcaatccccaaaagtcaactcgtactatgaataagtcctaatcagtttgtgacagacccaatagaagcagggaaaaccaaaacagtctacaacactacagttagagctctgtaacagcacaaactccagaaaatactaatggggtctatgctgatttcaggggctctttccccagagactttttcctgccaagaattgatcagtgctcaaggcccagcatattcatactttggcctcactgtttggaggcttgctggggattggagactggaaggaaggaagggtgggaggcctccagaacacaaagacatattccagaaacttggagccagctcttcctccagggacaatacattgtcatgcatttgggattctatgattcagatgatgaggacatagacatactatagatcaatggggtcaagatggaaactggaatgatctccaccacttcagactgactctgccagatcaatcttaagcagattgagagggtgcaaaactctgattaagcagaggaaatatgacctgggagagaaaaattagggagaaattacttaaaaagtggctgagcagaactgaaactcccaaaagaagtatcaaacagttaatgccatatgaaatatgtgttctgggcctggaaatctcaggagatggacctcatattagtttcacattccatgatgatgtggtagttcaagacaaggacttcggaggaactggctgtgtccaaattctggttctaacactgactagttatgtgaacttaagcaagcttcttaacctctctatgccttcccttcctaatctgtaaaatgggagaaataatactatctcagagggttgttatgaaggtaaattgaattaatttatgtataaaagcactcataagagtgctgctacttataaagtaatataaaagttctcattattattttatattaattatatacataatgcatataatatataatgatgcttacttgtacactatataaatattataattaataactattttatcttttacatctattatattctattgtactgtgttatatacaatacgtgatataccacgtatcatacggtacatatatattattctttattggtgactacatctgcattgcagaactgaatctaatttatattttatatctacctttttttccttaaaacttgtaactgctttctagatttcctgaggaacattccaaataatctggctcaaaactagctctaacatatactaattgtggaactgtgacaaacctccctaagtccaagttagttgatcttgaacataggggtgggtaaagatctaaataagatagaacagagctgctcagccaatgtgccatgcattcgttacaagcaagccaaatagtgagcactttagccttgcaaatagacagccagggtctgggttaattggggctcttacctggtcatctctgaccataactgtccatttactgtgacctacaaatattatttttgtgggttcataataacctgttggagagaactgtaagagacatcacgttggaagcattgagcaccaaatgtggaacatagtaggagcaccaaaaatatttgcttttgtggttgctgatgacaacagtggtagcgcaaggaagacgagacagaaaagaactttttttttttgctgtcattgttctgtttcttagcaaaagtggaattggaacctgttttaatattactactttaagtagagaggccatgcagcctataggtatggtctgtgtaccttggaagtcctgggtgttgtggaaagtgtgttgaccttggagccatgaaaagtagggtgaccagctggcccagtttcctaagaatgaggtggtttctaggtaatgggagtttttgtacttggaagtgaatcctcactctgaatatatgacttggcctctctgaattatattttcctattgtcaaatagggaaaacaaatcctgacttgtagcacttttgttatcaaataaaaaattgtacctacagtatgtgagagataattgaagtaaaacaagtgttatagctgctatgttccacccattccaccctccagttagaggcatcagagtgtgaatataagcttcacacttggtagttgcataaacatgggcaagctgtggaacatttcagagcttctattttatcatctgtaaagtaagactcataataccaaccttgatgagttagaggaggattaaattaaaagagaaaattactccataggagcaattattagatgtgatttccctcctgtttctccctttattttttcttctaataaattttcaatccataaatcttatacagaatgacctttctgagaaataaagcttttaaactgtggttgacccctggtattctccatgcgtctcagttgagagaattttagaagtggtgcttctccatgctacccgtgcctttcctgtagagaagatggtgttctctatgttgcatttgcacaaacttcagaaaacagctttcagaaacacctgaggagctgaccaagatttcactagcatgtcattgagttgacatagcaaataagttcttgtatccacatctcattagttttccctcatctttcataatgtcccatagaaactgaatgagagatataaaaatggctataaacctcttccacatctgctaagatgaaaaactgatttttactcagttttataaattttctctcctctttatctttccttcctcccctttccttccttcctcccctttccttccttccttctttccttccttccctttctttcctccttccttttctttccttccttccctttctttcctccttccttttctttccttcctttttccttcctccttccttccttcttcccttttctttctttcctccctcccttctttccttccttctctcctttccattatttctttagttccttccattctcatctggatcatggtttctttaactgcttgcaattcttcttgacttcaattttagttgtctctctgctttccttatcattggcaattatggatggattttctctttttttctgaataatttattcaattacatactcaataactatttgttagcactcctgatagataatgtgtgagatactgatgaatggaaaaaggcataaccctatggtttctttcgtaaagtactattctttagcaaaacaatttttatgaatatctaaaaaaaggagaggcttgctatgtacattgtttcattcaatttccaacaatgtaaggattagaaaaatataacagacttgcctaaagtcaccggctagacagtgacagattcataattcaatccaagatctgtttcactgaggcacagtgattcattctaatttgaatgtgcagtgaaataatttctgtagctcttctcgtttttctacttttataactggttacttaaaagcttttactaccaaagtcttccccagacaaatatgaggttaggaaagtcttactttgatgactccttctaccctcaaaagcccctgtccttaaaagttaacatctcaaaaagccatttccactcctctcacatatatatatgctgagctattccataaccaggattctttttatcctatcaaactgtgtctggtatttgtcccattcctttatatctgtgtcctttgaaacacacgatttgctatactagccctgtatcctaacttgtgagcagccattagtgttagtactacttcattggctggaacattctggtggcattgccttaattcaggaaggtagtggttgagaaatgcaggcagtccttggaattaagggaagaatgtgtcaagttggggaacttccaatcatattgggtcattttctagagatatgtagctctatttgacttaaatgaacaacatttaagaacccattcatctatattattttggtagatcacacgttttcaatgtaaggttgaaattcaggccatccaggaaagattgaaaaatttctgaggagataagcagctctggacctggctttgggctttcttgatgtgagttttatatgtcgtttggccaataaaagctctgctggatcattagctttttaataggataaataattacctctaacacaaaatatttggaatggaaacatttggttccagatttttaaaaaaatctcattaaaacatcacattaattcagccctgggttcactacaacttaaagtgagagatttggcagccttggtcagtatgcctcaaataagttcaaacttgggaaggttttgtaaaaacaaacagcaacaataaaaaccacatcagtcttcctttcctcgggactaagtagattcttagttctgctgcaatgtgagagagagggaaagacaagaacacagtccctggaatataaccttcttgggggtttggctcaaagctattccttttgagtgagtagaggttttctgatctgtcatttagctacaacgtgaccaaatattttcttgcctgtctgcaacacccagtctatagggagaatgaccctttcaccttctaggtccaaagacatgaaattgcccatcactctctcttcctctgctccttggcatgcagttttcttcttgccatttttctctaaaccctattaatcagcacctctgaaaggccccattactgagaatatttaaagtatgacaggataatacactaggaaatatactgtggggaatattatagtcctggcaggactaaatgacctaaagttgtctcagtctccagtgtttctttgattaattaaccccatttctcagaattcttgagttcagagttctctctgtactgaagcttgtgtgtggccagtgcagaggaaaattttttttccatctctggtgtgctttctttgccttaggtttgtccttactcttaaatttcagcttttgtctctaaaacatccataagctcaacaaggatgactgcatttctggtattgactagacacagttcgtggtactggtgagaacaaaatggagcaagattcaggccacacctcaagcagctctaagctctggaggggaaattgttcactaggaggccttatggacacacagaggaggaagtgcttcactttgccaacagtcccagaggaagcaacacatgagcaaagtctcaagagattggttattgtttgcgaagcagatggatcaaggaaggttattagagaaagagagaagatgatgtacaaatatgtggatcattcttgccccatttattggagctaaaggtattcagtgtatctagagtgtgagagtcaagtgaagtggtagaaaagaatgaacatcaagaccagctaaataaagaaatgtcatttacaataggccaaggaactcagtcttcttcctattggtagtggtgaaccatcagaaatgttttagcagagctgagtttttgaaatatcactctggtaaaataaaaggatagaactcggaggaggatgaaagatgggagaacagtcagaaggctactggaaaagttcagatatgagataactggagtagtaagatctgggtctatggatgtgaccgtggttctttttggagatacagctctcttccctggccttataacttgctcttttaattaaaagtaaaaacaattctctaagatggacaaatatattcccaatgttccaacaggctttcttttctcttcctggccctgtgtaaagagctctcccaactcccctctgttttatttcattgcagttgaatatttaagactgtgatacttctatcaatcagcaatcatggaataatcttagtttcctaggattttagagggctcagtcccaaacagtttggaactcaaacagtcccaagatgtttgaaataccactgtaaatacaaaaagaaagttacagtttgatataagatgtgacaagtgttatgagtgagtcttcttaaactgacacagtaacacctgtcaataaatttggaaggagttataaaaaaacacacaagtcaacttttgggtttagaacccacttcatatctaccaggtacattaattcattttaactggctacagccattttcaaagtgcattctaaggctcagtttcttcaactctgaaaagcatagaaaaatgcctatctcactcacttttcagatcaatcaacatataagaacgcactttgtaaactttaaaatactgtcagattaaatggtttgggttgtaatgtgtaagagtaagtaactgattagtgacagagccaagacaaaaggtctcctgatacccatcctagcctagtatgacaatgtgtgcgcttactttttatttttcatattttcctgtatacactttacttagtttcaaaaagaattaagcctgaataccttcttttcctgtagcaaactaagtcatgtgtatgggtgtgtataaaacattatactgtctccctaattctgacaccccaatatggtgtttagaatgattcagtcaagctatggactacaatttactttagaagaatttacaaagaatacaaaaggggttgaacaacttgcttccttaaaatgactaatagaattctcaactttgctttggtattaaattcacctatggagttcttaaattaaaatgaaacaaaacagaaaaacagttttgatgctcgagctccaccacaagcctcttgaatcaggatatcctgtatttcccttaatgattgaaccccaagacatgaaattagctaaatggacagtggtgatcctggtacgtgcttaagtggatagttggcccccacaacctctgacatgtaagttcatagagcacagtagatctgcaatgcacacagatccccctgccttgcctcccaccgcacagccatgcctccatgcactgctggaaatgcacagcatgcagacccatttggactcacaatcaccacccatgttatattgcactatgctagataaaaacatgaatgaacacaattgctgcttacaaggcattctaaaggtatgcgtggcaggtaaagaagtaaacctaatgtgagtataatatttgcagttatatatatatgccaaagtccatgttaaaggagagatttttttttttcactggaagggagcaggaaagaaaaggctttacaggtgaggaaatttctgggcagaatttaaagaatgagtgagaattgtccaagaggaagaaagtgggtcaagccagtggaaatggagagcaggtagctgttgggagatgaaagaaggaaggaagatattctgggaagatgagggagtgcgtacaaggagtcatgaaacagcctcgaacacatgggaccttcaggctgatgggagtaatgatgggtcacacctttgagggttgggggggcctcaggggatgtggagggagaggttagtaggggtcagtccaaagggccttgagtgcaatgctatggagctccgctgtgctattcccagtacacagcatgtctctccattctcgttttcccaatgatttttcaaaaatacacatctaatctcaagtaaagaaatattcttaataacatttctgagccagaagggaccttctgacaaaaagtgcctctatcacattctcttctgccttccttttataagaagagtcatatatgatttctggagcattcttttcctgtcttccaaagcagaaaactctgtcctttctttgctgtcttccaaagaggatagcactgaaagctgtcatcctaaggccctttggcccttcatctctctcaggccaacagacagatcctctggagtcctcacctggctctcatttctcgtgggtggcagcattattgttctaagacctgttaacattgaaacaagctcagagtcagttatagaacagggaataacaatccagagagagggtttgtaacaaacagtcagaggattcagggctattcaaactacatagcattcaagaatgagctccagttttggagataactaataatcttactagagatatgaacatcatcagtgcaaatcccatgaactttgcacctgctgtaagagctagggagaaacattacttctttttccacatagaattgaccctgaaccctgactagaagtgagtagataccaggtttaggactgtgaaactgagtctagatccctgtctcatctgccaactgctctggtctgccttggctcatggcctgggaagccggatgctttagaccggggttcccaacccctacgctgtggactggtaccagtctggtccatggcctattaggaagcaggccccagagcaggagatgagctgcaagtgagcgagcattaccgcctgagctctgcctcttgtcaaatcagcggcagcactggagtcttgtaggagcacgagacctgttgtgaattgtgcatatgaaggatctaggttgagcactccttatgataatctaactaatgcctgatgatctgaggtggaacaatttcatcccaaagccattccctccactctaccatctgtggaaacatcatcttccatgaaaccagtccctggtgccaaaaaggttggggactgctctttagatggatgggtaggaattcggtggccaggcagagactgaacctacataggatggtcacaatgaacctcgactattaatgtgttacagatttacataaaagcttgcccacagaagcatctaggtcacagaaacacattctctggatctcaaaagggatagtctccatattccatcaggtagagaggagtggaagagaataaagtgttacttagagtaagagttgggactctgaagtctgcattatctggttcaaatgattctattatcatggttaatgctctggagctgccatatcaggccaacatccagggaaaggtctaggtttattttagtcctcgaggtagcccaacactcaccaaagaaaacagtcaatttttgatttcttaaacaagttaattctttgggacttttattgcctttgcctcattttcctcctctgtaaagtagaggttaaaaatacctactatgttcttgtggaaattgcctgacgaaatgcattaaagtttctaacagagttcctgccttcttagtagaaatgtacgaataaatgttggtttacttctctcctttagtttcttgtgtccctgtgtaatttacatggagtagtcagataactgttttgtttttttttaatatggcagttgaccaccaatgtaaatctgaggaaagaattatgggaaagcataatataatattttgtgtacctgtaaataagtgacatttatttgtgaggtaattgactgaggaactggcttatgctttaatctctccacagtaatgacttaagtactttgtgctcagcagaggttccaaaaatttttatgtattagatgatttaggagatattttgaacttttactcatttaattttaaaattgggggatatttaatgtaaataggttgccagaattagatgagttgggtcacatcagtgcacagaaatttatagggtccaccaccaatttctagtgtggtgttggtgttctgctctgcaaaacattctaagacattcccacttactgcaaggagtgggggtaaaaacgtgtgtaagagagattaaagagaccaatcatttttggcaaaatgttcatatttagaaagttatgaaaacttaagaagttggtcaggatcaccacattgatgaaaactgcacattatcaggagttattgaagtagcacactgcatttttaagattaattggagcaaagaggaaagacaagcacccaggagataagtagtacggttctgggtttggtggattcagtttgtggactgggaggagatgaggggtctccaatctttctgatatatttagagagaagcaaaatcccaaccccagctctaagtaacactctatccccgtcctctcctcttctacctcccagaatatggagactatgaatcaccttcaaagtgtttgaaggtgattccagaattttgaaacaaacaaacaaaataaacagaacatttatagcaaaggagattttcataaaggatgctttggggaaggaaacggtggggaagcataaagtaagttcgttgttcatgctttagacctgttgagtctgaggtggtagtaagtgtaacaagcatatatttcaagtcctggtgagtaatttgtgttttcagccagaaatatgggataaggacacagtaagaagataaggcaggaagatggataagacgtgtcagttaaaaccgtaaaaagaatgatgtcttccagaggaattaaagagaggacacattataaaagcctgagaacttgggaacacccacctttaggacagaggacaaaatgtatagtagcaaatagaatggcgaggtcttattcacaaaggtaaaaggaccaagagagccttctgtcatatcagagaagtcaagataaagagaaagtgaagaaggcaggtggccagctgtgatacaccgcagaatagtgaggaggcctggaggccaagaaaagacacatttgcacccggctatttcctttcagtgccaagattctttaatgccattgtgactttcaaaaaggcagttcagttgacaggtgacatcgacaccaaagaaatatcaggaggataggttaaaaggaaatagaagcatagttgtagaacattcatctggaagtttcgctgttaagagaaggtgacaggtaaaaatagtgagtagggtcatttaaaaatcatttcaggatgagaaaaaataccttatttgaaagcaattcagttgaggggaaaaatctggagagattaaaatagaaagatgtagtaaaaaaaacacaaaaacaaaaatccctcaggaggcagagagaagacttggcacaactgggaaactggccccctctctgaggtcagtgaccagaagaggtaagtgggtgtaaatgacaatcatgtcatcttatctttgaaaatactccctagcttacaagactataaatgcagttttttatctaaatattttttttccttaggtcattaaaccttcacagtcactgtgtaagaaaggcattattacattaatcttacattgtataattgaggtctcagagcaggttaggaaataattcaagattccataaacagggagtagctgagttaggacaagatcccagacctcttaagcctaaaacaaggcatggcgctttgggaagctgaggtgggtagatcacctgaggtcaggagttcgagaccagcatgaccaacatgatgaaactccatctctactataaaatacaaaaaaaattagccaggcgtggtggtcaggtggctgtaatcccagctactcaggaggctgaggcagcagaattgcttgatctcagaaggcggaggttgcagtgacccaagatagtgcgattgtactctagcctgggatacaagaacaaaactccatctggaaaaaaaaaaaaaaaaaccaccaaacttaaggcatgggccaagccttctaaatgctcatcacatttgtctacaccaatgttagaatatgaccaaagaagatgacagcgatgttgtgggttgtggcctcaagctattaaataaggcaagtgtgtgtgtgtctctgagagatacacacacacacacacacacacacacacagaggagagagagagagaaagagacaggcatacacacacacacacacacacacagacacacagaggagagagagaaagagacagacacacacacacacacacagaggagagagagagagaaaaagagacaggcatacacacacacacacacacacagacacacacacacacacacagaaagagacaggagagagagtgctgggagagggtatgggttgaattgtggtcctccaaaagatacattgaagccctgattcccactctcaatgaatgtgtgtttatttgcaaacagggtctttgcagacgtaattaagatgttactcaagatcttagttaagatgaggtcatactggaataaaagtaggcccttgatctaatataactgacatccttagaagagaagagacagagacaaacacatagaaagaagacagtcatgtgacgatggaggcagagattagagtgatggatctgtaagcaaagcaatgctaaggattgccagtaaacatcaaagaggcaaggaaggattctatcctacagtttctagaaggagcatggccctgctaccacctcaagctattaaataaggcaagtttgtgtgtgcgtgtgcgtgtatgtgacacacacacacacacatgcgcgtgagagagagtgttgggagatggtatgggttgccttctggcctccagagctataagataacacatttaacacatttctgttgttttaagccacctaatttgtgatatttgttacggcagctctagagcagaactgttctgtggcctgttaggaaccaggccacacaacaggaggtgagcagtgggccagtgagcatgaccagctgaactccacctcctgtcagataagcggcagcattagattctcataggagtgcaaaccctattgtgaactgcacatgcaaggaatccaggttgcatgctcctgaggagaatctaatgcctaatgcctaatgatctgaggtggaacagtttcattcagaaaccactcccccaaaccccaactgtggtccctggaaaattgtcaaattgttttccacaaagcaggtcctgatgccaaaaggttggggactgctgctctagagaactaatatgggagcatatcacctagatggatttggtgaaaacttgtccaggaaagagaaggtgtgaatgaccaaagtggatggtgatagtgggagttgacaaaggggaaaatgcatttctggaataaatacttgcaggccagtagtacaacatcgtggctcagcatagtaattttggaaccagacaccaatgggttcaaattgttattctgcctcttttaggctgggagacactgataatgttatttaacatttctaaggctttgtttacttatttgcaaaatggatataataattcctactccatggtattatgatgaggattaaatggcatgaaacatgtaaagtgcttgccacagtgccttttagtgctcaataaagtgaggtgagttcctagtagttataatagttacagttgttgtttatgcctttaccattatatgcctttttctaacagcatttttgtctggaagtctttccagacaaaatatttccaaagtatagccagcatttttgtccacagggagcagaaaaagaaagtgatgggggcaaaaatctaacactgaagggtatttgtttgtatgaaaagggcaccatgatgctgaggtcggtagtgatactaatagtagtggcagtagtactagtagtaggttggtagtagtactaatagtaggagcagtaatagaaggaggtacacaaagataaggagaaaaagggacagtggttctattaagtgattactatgttccagatacttctcacatgctttgcatatattaataagaaaaccccattgtctcagcccaaaacctccttaagctaatgagcaacttcagcaaagtctcaggatacaaaattaatgtgcaaaaatcacaagcattcctatataccaataatagaaaaatggagagtgagttcactcaaatgagtgaactcccattcacagttgctacaaagagaataaaatacctaggaatacaacttacaagggatgtgaaggacctcttcaaggagaactacaaaccactgctcaaggaaataagagaggacacaaacacatggaaaaacattccatgctcatggagaggcagaatctacattatgaaaatggctatactgcccaaagtaatttatagattcaatgctatccccatcaactaccattaactttcttcacagaattagaaacaactactttaaatttcatatggaatcaaaaaagagcccatatagccaagacaatcctaagcaaaaagaacaaagctagaggcatcacgctacctgacttcaaactatactacaaggctacggtaaccaaaacagcatggtactggtaccaaaacagatatatagaccaatggaacagaacagaggcctcagaaataatgtcacgtatctacaaccatctgatctttgacaaacctgacaaaaacaagcaatggggaaaggattccttatttaataaatggtgttgggaaaactggctagccatatgcagaaaactgaaactgaaccccttccttacaccttatacaaaaattaactcaagatggatataagacttaaacataagacttaaaactataaagcttctggaagaaaacctaggtaataccattcaggacataggcatgggcaaagacttcatgactaaaacaccaaaagcaatggcaacaaaagccaaaattgacaaatgggaaccaattaaactaaagagcttctgcacagcaaaagaaactatcaccagagtgaacaggcaacctacagaatgggagaaaattttttcaatctgtccatctgacaaagggctaatacccagaatatacaaggaacttaaacaaatttacatgagaaacaatcccatcaaaaaggaacttaaacaaatttacatgaaaaaacaaccccatccaaaagtgggagaaggatatgaacaaacacttctcaaaggaagacatttttgcggccaagaaacatatgaaaaaaagctcatcaccatgtggacattagagaaatgtaaatcaaaaccacagtgaaataccatctcatgccagttagaatggcgatcattaaaaagtcaggaaacaacagaaactggagaggatgtggagaaataggaacacttttacactgtggtgggagtgtaaattcgttcaaccattgtggaagacagtgtgacaattcctcaaggatctagaatcagaaataccatttgacccagcaatcctattactgggtagatacccaaaggattataaatcattctactttaaagacacatgcacacgtatatttattgcagcactattcacaatagcaaggacttggaaccaaccaaaatgcccattaatgatagactggataaagaaaatgtggcacatgtacaccgtggaatactacggagccaaaaaaagaatgagttcatgtcctttgcagggacatggatgaagcttgaaatcttcgttctcagcaaactaatgggaacagaaaactaaacaccacgttttctcactcataagggagttgaacaaagagaacacatggacacagggaggggaacatcacacactgaggcctgtcaggagattggggggttgggggaggggatagcattaggagaaatacctaatatagatgacgggttgatgagtgcagcaaaccaccatggcacgtgtatacctatgtaacaaacatgcatgttctgcacatgtattccagaacttaaagtataataataaataaaataaacataacaacaaaaaagcatgttaaatatcttagggagaataacattgaatttgaaatctaaggctaagaatacatttattcgatatgaagaacaacattttggtcttcgtgaaaaaactgaaagtaattccagataacagagagggaatggaatacaagaccaagttttaaaaaagataatagataaaaaatataattgttgaaaataaagcattcatgatgactcatttgtgtaacagaacggtatattatgctgatgaatttttgcctttttatgtaatggccatagatgtcaatggatagtgtaaacatgccaataatgtcatcagcataaatgataatagtaatagttgtcatttattgagcatttactgttttcctgtggtagtactgatggtattatgagtcttattttgtataattcttaaatcaatcctctgaggtagtgtttcacacacctttaaggtgctgcttcagatttgctcagcttcacttatctctggaacccctggctacttgttccatcccagttgcctctgcagtaactaactaggcatgggatttaaccaatatcgcatgggcacaacccaacccaccttacctcatacctgtgctggtcacctttcggctcctgtctcagagttttctgacacttcctgagagatacagtgccacagtacctgttcagtgtccatgtgtgcacagtacctgttcagtgtccatgtgtgcacagccctgaagtacagggatttattgccatttgggatgaacttgtgaccaataaaaaatggaagttcgtgagtatatttgcctccttttttgcccctggactaattttcctgtgatgcaatagcttcatgagacttctcagtggagaatctcctaagttagagcaatgggttgttcttgatcacacatgatagccaccacaatgacatacctctattatcccctgttcttctcagtttcattaaccccttctcaaattcctgcttctctgatatttctcttccaaataaattagtatagcaccagcatttgccttttttaagaacccaggctaagacaatggcaccagaactaggctgttttataatgtctgttctgcagtggcatcaccatctctgtgaccttcacctgtgcataattgggatgaggtgaaggtggaacgcagagcatgggatatgcagtggttgtggtgatgaaagaaaatgggcacaatgacaagtataggaattgtggagttgggtggtgttctgtggttagcaggtctatgcgaacctacccctaaaagtccaaggaagctgagaagccaaagaaagaggctgacatatgcagtttttcaggaaagaaggaggtaaacatctaacagggacttacaacagaagccatgtctgtgtcttgggtggtggcaagacaagatagtggattcccacaccattacccctcagacctagctaaactgtagggaaagagatgtggaggataaatactgaagagcaggatttacagtaagtataataacatcagagttgttttgacctaagggcaggatttatggtaagtacatgctcttacacaaggaagagtagatgatatagaaatcttagaggcgttcctaatattggggttaaacagaagtcaacatggcacatgagcagccaagatggagttgctttagtctcaatagatggcttttgttaacaatgctagtagccttgacaatagaaaatgataggctcaggtcaactgctagcttaagtcatgtaatgaaacctggagtcaccttataaaagcttttagtaatacccttatcttctgtaactataaggcatacagtactgaaaatcaggcacagactctattgtaatggagctgctaatggaacctaaatactcacctttaaaaattaaggccttgagagaaagggtgggacatacgacctgagatatggacattggacgaatatgtctgagaatctttaatccccaaattctcttgagttcctcaggccagtagaagtaaccccctctcaatttctgcaggacaacagtctgtcagtgccttgaaatttgcaatatctcacctgaagaaggagccttgcaaaataatgcttatacacttcaagagtctttctcgtatccttcattgcctccaggccaataatcagggttaggtcttagcacagaccaatcaggaaaatacagccttgctctaggaaatatagactacatgcaataataaactaaaataaattgcaagatcttgctaatgtgtttgagtgagaaacaggagaaatctatatgagaatgtatcctaagtaggtaagattgggatagcgagaagcaaatataagactggacagggtagaatttattaacataggagaaatcacctgagaatctgggtttaatgttttatcaaagaccctaaagcaaatttggaaagtctgctggatccaccataacaacaggctaaaggagaaaaatcatactcatagaattattgtggaaaaattaacaaaattcagtaccctttcattaaaacctttcatctcagaaaattagaaatggaggagaattacctcaacaataaaaggcatctacaaaaaaagcatatgaataatattgtatttagttatcaaaggctaaatgttttcccctgatgattgggaacaaggcaaggatgtccactctcaccattactattcaacacaagcctggaagctctagcaagaacaagaaaaaaacaaataaaagaaataaaaggcacatattagaaaggaagaaatcaaatcctccctatttgcacataagattgtctatgtaaaacattccatggaatctatcctacccaataccccccaaaaacttgagaactaagaaatgaggttattaagattgtagaatctaagatcaatacacaaaaaccaatcatttttctatactaaaaatgaacatactgaaactaaaatttaaaatataataccatttataattgcttcaaagaaaatacagcacccacatatacccttaacaaaacatgtacaagaatggtatgattacaattataaaatgctgaagacagaaattgaaaatctaagtaagcagagagacatactatgttcatggattggaaaactctatatagtaaagatgatatttatctccaaattgatctataggcttaataaaattcctatcaaaatcccaggaagtttttttttttcatgaacacagcttattctaaaatttatatgaaaagatacatatcctagagtagctaaaacaattttgaccaaaaaatatagtgagatgaatcactctacctgacacttgagcttaatttatagctatagtaatcaaggcagcatgatattggcaggggaatagacacatatagatcaatagaacagaaaagagaattcagaactaggtctggtatggtgccttacacctaaaatcccagcactttgggaggccgaggcaggtggatcacttgaggtcaggagttcaagagcagcctggccaacatggaaaaacacgatctctactcaaaatacaaaaatagctgggcgtggtggtgcacacctgtaatcccagctacttgggaggctgaggaaggggaatcacatgaagccaggaggtggatgttgcaatgagctgagattgtgccactgcactccagcctaggtgacagagtgagactctgtctcaaaacaaaaacaaacaaacaaaacaaaaaacaaacagaaaaacagaattcagaactcaacctacgcaaatatattcaaaagttgcaaaagcagttgaagggaggaaatcattttaacaaatggtgtagaagcaattggacatccataggaaagaaaatgcaccttgacctacaactcacaccttattcaataattggctgagtctttagtcttgataccaaaagcatgatccataaaaggagaaattgataaactgggtttcatcaatattaaacactttcttttttgtaaaagactcaaaaaggagttgaaaagacaaggtagaaactgtaaaaaaaaaaaaaaaaaaaaaaaaaaaaaaaaaaaaggttgcaagccagatatctgggaaagaacttttatcaataatatactaaataaaaactcttacaactcaacagtaaaagttcaaactgtccacttagaaaatggacaaaatacccaaaaaagagacattttagcaaaggaagtatacagatggcaaagagcacatgaaaaatatgttcagcattattaaccatcaggaaaataaaaaaaggaaggaaggaaagaaaggaagggaagggaaagagggagggaggaaggaagggagagagggagggagggagggagaaagcgagagagggagggagggaggtagggaaagaaagaaagaaaaacaaaccaataatgggatacctatcagaatggctactttttttttaagtgatagcactaaatattgatgagaatgtagagaacctggatcactcattcattcctggtagaaatgtgacagatgatagatggatggatagatagatagatagatagatagatagatagatagatagatagatagacagatgagataaattatagatacacatgcagttgtaagaaataatacagagagattccaggtacctttcattgagttcccttcagcagtaacttcttgcaaaaaaaaaatattacaatcagaatatttcacactgatgtaatccactgattttatcatatttctccagttttgcttgtacttatttgtgtgtgtatgtacgtatagaagaaaagttaaaatcttcagagtagttccttaaagcttctacacatcaaatccctatattaaggagatagagatccctttgcctatgtaggaaatggcaaatatcattgatgttctggagaactaactgttgccagagagtagaagataatctcaatagagatttgaggatgatgcttggtaaagtccgagggatgcagtgtctgccacctgaagaatattgagaatgaagtcagaagagtcggggcaatggaaatattagaattgatttattacacgacatctaaaatttaccatctgataatattttcttagaatttccagaaaacactcctttcactaagtcagtggtccttacacttgaactttagagttcccaggaggagatcaaaatttccagaagggcttgttagatatagatttctgggtcccattcccaaagtctcatttagtagaccctaaaatttcaggttttaaaatttgcatttctaaaacgctcctaggtgctgttaatgttactgttctggggtctacactgagagagaactctgcactaacacagtaagaaatgcactggggataagggagcatcagcattgttgagaagttcagtggtgggtgtcctctgtaggctagatatgaccattggaattcttaacatggaaataatctccctaagacaaatggtgatgatgagattccagagtggttgagactgggtggcagcacttaactatcagacaaggagaatatgcctgacataattattataatgggtaagaacactgtcatagtaatctggatgtctcaacctgtagaagtttgtagcaatgtctgagatcaaggtgacttttgattaaaggcaaaggtctaccccataaggaagagccctacaatgtcattgcaagtacatgtggtaaagatccctctgatttcccccaaagggccctgtgctaggattactatgtatgaggagcaggaaataactagactatttgagggctgttagatagatgttctaagctgacaccaataccaggggacctaaaatgccttcacatttctctagagttggggtataagaaagccagctattaaataggatttggctcaagcatatctcatagtgggcccaatgggtgtgtatgtatatatatatgtatatatatatatacacacacatatatatatatatgtgtatatatatatatatatatatgtgtgtgtatatatatatatacacatatatatatacatatatatatgtgtatatatatatatatatacacatatatatatgtgtgtgtatatatatatatatatatacatatatatatatatgtgtgtatatatatatatatatatatatatatatatagcctgtggttatttggttattttcctgggttctgaatgtatgatggacatagatttacttaatagccagccatgttgattatctgatgtgtagagcaatggctgttacagtgagaatggctaagttgaagcccccatgtcctctccctttcagctaagatacacatcagaggcaatatttgtcttctttgaggaaactctgagaccactaccaccaccaaagatgtgcaattatgtaggagtagtggtcctcttcctttctcccatcaatatgtctagatcctgcaaaagccaggtggattgtggtggattatggtggctaccataagataaaagatggtagccctatctgtgccttcctgctgggtgtgttatttttacatacaattaacatagtctctggcacttgatgtagggcttttttttttttttttttttgagacagtatcttgttttgtcacccgggctggagtgcagttgtgtgatcatagtcactgcaaccttaaactcctaggcacaagaattcctcctgcttcagcctcctgaataagcatgactacaaatacatgccaccttgcccaactaattctaaaaaattgtttgtagagacgggggtctcactttgttgcctaggctggtctcaaaatcctgggctcaagagatcctcctgcctcggcttcccaaagttctgagattacagccatgagccactgtgctcagcctgtcgtacgacttttttatggcaaatgatttcttgatcattctggcaggctgaataataacccccaaatatgtccatgtcacaatctcagaaatctataaattttaatgtacatggaaaaaagggactttgcaaatgtgattaagtgtagaatctcgagatgggaagattatcctgaattatcccagtgggctggatgtaatcatacatgtccttataaataggattagaagggccagagtcagaagaaagcactgtggtgacaggaggagagactgtagagatgcactttgaagatagaggaaggggctacaagctgaataacaccaggggtctctagaagtagaaagtagaagatctagaaaaggcaaagaaacgagttttcctctaaaaccccagaagggaccagcgcttctgacaccttgcctttagcccagtgaaattagttacagacatcttgtcttcagaaatataacagaatacatttgtattgttttaagaaaccaaatttgtggtaatttgttgcaatagccataagaaaggaatatgccattagtatcagcaaaaaggattaacacagtgcaaattactcactgcctgcaccaaggctgtgataaagtttaaaattacatatacagtcatatataattcatatggtcataaagttcaaaagtatatatatatatatatatatatatatactgtgtatttatatggtataataaatattatatatatagtatgtatataattgaatatattattgtccttaaattgatgacatgatgttgactggacctagtgagtaggaaatggcaaatattattgatgtcctggttattacatgttgccagagagtagaagataatctcaacagagcctcgtggggtgatgcattggtgaagttcagagggatgcagtctctaccatgtgctgggactgtctaaagttaaggataagttgttagaatttgcactttctaccactaggtaagaggcacaactcttagtgggcttcttagaattttagaagaaacatatgccacatatgagaatactgctccaacttggaaaaccgcaagggtcaagtgggctctgataaagagaagcctctgcaacaggctcagaatgcaatgcaggctgcccttccactcatgccatatgaccctgtaaatctgatggtgtcagatgttgctgtggtaaagaatgatgatgtgttgtttctctgacaagccctaattagagagtcacagttcacatgccagatttctgaagcaatatcaggccttctatggaagagaaccacttgccatttgaaaaaaaacatcagtagaactatttggtcatttcaaatggaaagaaaagtaatctgagataaggacacacaggcttctgggctttgaggaatggctgagcttgttgcataggattctggaagaaattaaacctgaagatcagagaccagcagatttgagggagagatatagtcacagacctgtaggaatggtcccaaagcatacagttattttattttttaaaaattataatatttattaaattttgttactatttataacatagatttattgacttttggttgggaaaactagttgcgtgcatttgttcagttcattgcagaatctttagcaccctggcctaaggattaaacgcccatagtataccacttttattgcaatagccaagaatgctgctacacattttcacacacccccaggagggtatttagttctcattctacttgagaatgatttaataccgtaaaacttaccaccaggtatgattcttagaataattttatatgtttccaatttttagagttagatgtatttagattatctcaaatatattattaatgtatttttaaatctttttttgaggtataacgcatatactctactctcagaattaagttttaaagaatacaatttgatgaattttttttacctacacattatacccatgcaatcaccatccaggttaagatgctgaatatttttaggacttcagaaatctttatgacccttttcaatcaacctctgagaggttaacttctaatctaacttctatcaccatgtattagttttgcctgtttttgaaccttattttttttaaaaaaaacaatcatagtaaagcattcagatctctgtctttaatccttccagaaagcatctaccaccaaggaggcttcagtcaccaggtggacagaatgactcatccaggcatgtgaactagtctctgactagtttatccctgtgttggtgcaatcagtccatgaccatgtggtcatggtggtaaagatgaaggctacacaaaaactcaacagcataagttctccctgatctagctactgtcagggcctagtgtctatcctgtcagcaacatacactgggccctccacgtagctccatttatttaaaaggccagccattaatagcagacaggccaattattctgaacgtcttttatcctggaagggtattaatttgtccttactggacttaataggtactccaggctatgatttcctcttttttgtcagcaaggactccacccataccactaagagtacttataaaatgcttgcatggcatctcatataacaatgcttcagattaagacacacattgtattagtcttttctcatgctgctgataaagacatacccaagactgggtaatatataaaggaaagaggtttaatggactcacagttccacatggctggggaggccccacaattatggcagaaggcaaaggaagagcaaagtcatgtcttaggtggctacaggcaagagagagcatgtgcaggagacctcttctatgtaacaccatcagatctcctgagacttattcactaccatgagaacagcatgggaaaaacctgcccgcatgattcaattacctccccctgggttcctcccatgacacatgaggattatgggagctaaaattcaagataagatttgggtgcagacagagccaaaccatatcattaaacccctgtaccctcccaaatctcatatcctcacatttcaaaaccaatgatgccttctcaacagttcctcaaagtcttaacttattttagcattaactcaaaagtccatagtccaaagtctcatctgagacaagacaagtcccttctgcctatgaacctgtaaaatcaaaagcaagttagttacttcctagatacaatgtgtgtacaggtattgggtaaatacacccaaatgggagaaattggctaaaacaaaggggctacatgcaattctgaaatccggaaggccagtcaaattttaaagctccagaatgttctcctttgaccccatgtctcacatccaggtcatgctgatgcaagaggtgggttcccatggtcttgggcagctctgcccctgtggctttgcagaatatagcctccctcctggctgctttcatggactggcattgagtgactgcagattttccaggcacatggtacaagctgtcaatggatctacctttctggggtctggagggtggtggcctgcttctcatacctccactaggcagtgccccagtggggaaatctgtgtgggggcttgcaccccacatctcccttttgcactaccctagcagaggttctccatgaggattccacccctgtagcacccctctgcctggatatccaggtgtttccatacgtcttctgaaatctaggcaaatgttgtcaaacctcaattcttgacttctgtgtccctgcaggcccaacaccacatgtaagctgccaaggcttggggcttgcaccctctgaagcaacggcctgagctctatgtcggccccttttaaccatggctgggatgcagagcactaagtccgagactgcacaaagcagcagggcactgggccaggcccatgaaaccatattttcctcctaggcccccaggtctgtgatggaaagggctgctgtaaagacctctcagatgccctggagacatttttccattgttttggtgattaacatttggctcttcgttacttatgcaaatttctgcagccggcttgaatttcttctcagaaaatgggtttttcttttctactccatcatcaggctgcaaattttctgaacttttatattttttgcttcccttttaacataagttccaattccaaccatcatagctttgtgaatacataaaactgaatactattaacagtaccctagtcacctcttgaatgctttgctgcttagaaatttcttccaccagatgccctaaatcatctctctcaagttcaaagtttgacagatttctaggacaggggcaaaatgtcaccagtctctttgccaaaacatagaaagagtcacacttttgcttcagtttccaaaaagttcctcatctccatctgagaccacctcagcctggactttgttgcccatatcactgtcagcattttggtcaaagccattcaacaaaggtctaggaagtttcaaactttcccacatcttcctgccttcttctgagtccttcagactgttccaacctctgcctgttacccagttccaaagtcacttccacatttttaggtatctttatagcagcacctcactctactggtaccaatttactgtattagtctgttctcatgctgctaataaagacataccatagactgggtaatttataaaggaaagaggtttaatggactcacatttccacatggttggggagtccttacaatcatcatggaaggcaaacgaggaacaaagtcatgtcttacaaggcagcaggcaagggagagcatttgcaggggaactcccctttataaaaccatcacatctcgtgagacttaatcacagcatggaaaagacccgcccccatgattcaattgcttcgcattgggttcctctcatgactcatgggcattatgggagctacaattcaagatgagatttgggtgggacccagccaaaccatatcacccatttaatggcaaaaagagtatgtccttgggcacatgcccatgagattcacaaatcatgtaatgtacttaatatggtttggctgtgtccccacccaaatctcaacttgaattgtacctcccagaattcccacgtgttgtgggagggacctagcgggaggtaattgaatcatgggggctggtttttcccatgctattctcctgatggtgagtaagtctcagaagatctgacgggtttatcaggggtttctgcttttgcttcttcctcactcttctcttgttgctgccatgcaaaacttgccttttgcctccagtcatgattctgaggccttcccagccatatggaactgtaggtccaattaaacttccttttcttcccagtttcaggtatgtctttatcagcaacatgaaaacgaactaatacagtactccatcaccacatttcagaccaaaagaatgctggaatagcctgctaaagctcaaatagagcagcatctcagaacaacatcacgaacagctgggacactattttctttgattgagaacatgcccagaatcaacaagagtacatagtgctatgtccccagtacttaagatacatgggtccagaaatcagtgtgcaaaaatagaatttacacatctcagcctcactcctgtcaactcaatttctattttgtttttcacccttgaaaactcagcctcttcctaattaaagaccctcagtttcccaaaaaagaagtctggtgccaggggacacatttagtttcctgcagaactgaaagctacaactctcataagcccatattaggcttatgagccagcaaacaagaaaagagctactctgctggaggtgggtgcttgactttgatcactatgaggcattatagtttctcctacacaatggagacaaggaagccctatgtcgggataccagaggattcaatggggcatctgtttgtgcttctgtaccccaaaacaaaggtaaaaacaagtgtttgcagcaaccacggtatcccaataatagatgcaaggtaactaagagttcagtccctatagggataaagttctgagtcactccatcaggcaagcaacccagaccagctcagtgtgcaagaaatcaaaaaagggaagtagagaagggagatcatgaatgtcatggtctcagaatcagctctatggcaccagggaatttaacctgtttcataaacactcttgccttaatccttctcagaaatcatagctgccaccagctaaagagagctccatgaataatttacaggccctcttagggataaattaggatctgctcataaaaatagaagtacctctgtattgtgagaggctggaatagtaagagggcatgtgtggatctgagtgctgctaggggaacactgtatcaggcacctccttatgtaccctctctgatccttttgaccttatgtgtctctaggctgcgtgttttgcccagttaccactagggagccaactcggcatggactttgacccacttcacatggatacaacccaatagaacttgtccatgccaggccactgtcaccttcgactctggagcttctccgttgacactaaagcgtgagatgctatgagacctacatggcatgcacaagccagaggtgtggggaagttaatttcctttggggaaaacctatgaaacgtgggatccagaggataaattcttcttctttcctttcctatggactgtcttgaggagcagtacttcttaagactactctaaaggcaatcccacgatatttagcaattgtgttcacttgctaccatgcagtgaacagtttagtaaggtacctacatatggactctcttgtctgagtcacttcccttttccaggctcttgcttccctagtattacatttaagggttaactagtggcctcaggctcttttttctgggtagtccaggctaagacaggtgtatactatttgatccccattttatagatgagaaactgaggcaaaaagaagtgaagcaactcgctgggatcatatatctaggtctttcacacctagatcagcctggcttaaaatctagatcttaattaatgtatttaatagaagacatgatctagttgctgaaaacagttgggatggtaaaaatcaatcctgtagattaagcagtaatggtttgaatggggtggtgtttaacggagtcctgaactataaatgatcaggagaggtgatttgataattactcagtgagagtaagtaaaaggctgttgccttctagcgtggcatagaccagtgtagggacactgttctgccatttggaaataccgtagaaaaagcattctataagagatgtctatggtgtttctggtaagcaggttcaaaaaaagggaggagagagagagaggaagaagtagaaggaaaaaaattaagacctggtcacagggtgagggaatttccctaacaagttagtaggtgaaatatatggctagggtaaaagtgatgaatagttagggtctgagctgaaagtttacaaggattgggatataaacgactatagtaggagacctgggcagggaacaaagggtgcagggcattagctgggaaggaggtaggtgtggagcagatatcagaagctggacctgccatcatgcacagaaatatgtgtatgatccatgtatgtacgatccattggctcctatcaagaaaagtccatcttctttcattcacacaggtctatgggccagatcacacacacaaagtgaaggaaaaacagtttcttatctttcatcaagtctgctattgaacaagaacatgctgcttctagcttatcccttgactaaactatatttatttatattctgcagtcttagaaagaaaacctctcctacccttgcaaacatgagaggcagaagttcatttttatacagctaaacagagattgcctgtttaaagaaaaatctggaaattggtactggatgaaaagaatattcactgactttaaaatattggagattatgctctgaagtccaatagcttatttgttcaataggccccatgggtagccctgaaaatagaacctgatgaaatcaaggcggggaagtagagaaggtcagtgacttaagagttaagataacaaagaaccagctctcagatcttcgtcctttcagtagaagcaattttttcagaggtattagcgtaccaatttacactatctcaactctaaattaattaacacagtgtaatggatgaaagaaatactccagacacaccgacatcaggcaatagtatcctaacttacctttcagattctactttttctcaggtcctccaacagtctgttctcaccccaagacaagctctcctttaaggagtctagttatattatcttctccttcaagccatacaatacctcccctttgcattagtaataaaattcaaaatttttatcctggtcccagtgacctagctctagcctgcctctctcacctcatatgggtaccctccccctcaccttcaccacatgttccagtcatactagtgtttgttctcttgtttagtgccttaatctttttacaggaggtttctaatcattagggttcagctgaaagaatccatctcagagggaccttctgcaacttcccagatagtagtagccattcctgctatgtcttgtccctgtaacatcactcttttgtttcctttatgctaattttcattatctgaaactatcttgcttatatatttatctgttcattatctgcttcctcatactacatataatcttcaaaagagcaagaactaattttgcagtgctcacagttacacctctagcacctagaaaagggcttggaagacagccacacacactcctttccccaaataaaaattgatgagtgagtaaatgaatgaatgcatgaaactaaatattcttagcgcatttcacagtctatacaacttcaggatccctgcatatacatccccaagattaccacttttattacaggctgttccagaagacttcctgactatcaaaaaaaaaaaaaaatgccatttagtacaaaatgactactaagccttccaagaaaccaaggacgttctagtaccaattgaatactattgcatgctggtcatttattttatttgtttatttgccttacaaattctgagttattgttgtgtatatgaagcaagggtcaccaaattacagcctccaggccaaatttggctcaccccctatttttataaatacattttaatgggaaaacagccacagccttttgtttacatatttttatggcttctcttgtgtcaaaaaggcagagctgaggagctgcgacagagatggtataacccccaaagctgaaaatatttgctgtctgaccctttacagaaaaagtttactgattcttgatatacagcaatatgtactcaaaaatagaaactgtgtgagaaaaagagctgcaaaatgtcagggggagaaatgagagcattgactggtgttttctttgggtaaaatccaggaaatttgatagtgaccaaattagaagtgtatcctcaaaatggttttggattagagcgtgagagagaagactacatttcagtggttagctcagaaatcagaagtttactggctgaagaccaacctttctttcaggctagttctgtattctcttgctaagagacacttagttcccttccatttcacactgggccccctcttcctacctttgtttgcatctgttctctgtgcaatccggaatgtagggaacactgccatcttcatgatgaatcgtttcctccattgaattgcaattacaggttttaatcagttcattatttcacctagtttttgggtcctgacagttatgctatggaaactaattgaattggctttacctcaaggcattcccacaagaagatttttaccttgccatttgggaattttttggctgtttgaccaaattagccctaattgctctgtaacctaaaaaaaaaaaaatcttatgtttatatttttcctttgaaagattttacattctattcctgctctgaacacagtgctctttatataaaaagacaaatcactggcctgtaagttagtgtgttatataccaagcttcttatagaagaggctatagagtgtttgtataatatacccttattctttttcatagccctcctttagaataatttttttaaagtgtggaaaggctggacattagattacattttttcaaccatttcgtatttctgctgctgcaagttctagtctatggaaaatatatggcccaggaataacgtttgactgtctgtccgtggtgacattatcttagcaagttcaccatgatctaaggctgggttctcagattttggggtgcctcactggcttacatcaaattgacaaagtttcatctgataaagaaatcaaaatgtcagttgataatatcatgatgagaatacagcagccaggcatggtagctcatgcctgtaatcccagcactttgagaggccgaggcagaaagactgcttgagcccgggagtttgagaccagccagggcaacatagtgagacctcatccctacaaaaaaaaatttaaaaaaatagttggacatggtggtgcatgcctgtggtcccagctactcgggaggctgaggtgggagcattgcttggaccctggagttcaagtgttcaatgagctagagctatggccactgcactccaccccgggcaacagaatgagatcctgtaaaaaaaaaaaaaaaaaaaaaaaaagaaagaaatgtagcagcagaggagactagaatgatttaatctccttggtcagcacgttctcttcttccaggagaacctacacatatgagaagccatattataatccaaaggttgtttggtgagtgtagaatgcaagcagagagaggagaaatactggttagaagattacattgttgacagtaaatgaacacccagctgcattcatctctcatttaggagttgcaacatcaaaagacaagaaaaccaaattctgggacagagcaacttgttctctgaaaagccatgaatgaggacttccaatattggcctctactctgctgattttctacatacattctagtgaaaaagtcttgctttagtaatcgtcagacaagcaactatttcatcaaatcctattcttactgctctctgccataggggccctcatcctctgaaggtgatgtctgcatatttcttattggatccattgcatgttaaatttatcagtttgattcacaaagctctggagtttctcttgctgtctctatttgctgtccatatgtagcagggtttctcagctttcgcactactgatattttaggtgggataatattctgttattagggattatgtaggatgtttagcagtatccctggcctcttccccttatatgtcagttgcagactccccacccaccatcccttagcagatatgacaactaaatatgacaactaaatattgccaaacgtctcctgagtaccaaaattgcctcctgtcaaggaattctggcatataggatagataggtgaaaagaagagaggattccttctaattcctttcagggatctagggcaaaaaccattcaacccagtcaagctgggttccagcttcatatcatttaactcctctacttttattcctctgagattccccttaccataaccacgatgtttatacaaatcaaatcctaactcagacttctatgaattttttatgcatatctacctttccaggcaagtcacaactttcttatatctgattgggcagaaggtttatagtatctcagtaaataattttcctcagttacatggagcatcatatttttattgggagagaaacatatttcaaaatttgaggtatgcacagtatctgtcaatacccatgactggcttcaattctgaaatctaattaatgtgaattctaaattccttgggttcatcaaatctttgcgtttgtcaacatagggtacagaattttggttgttgttttcttctctctcttaacactttaactagagttaagcagttttcatttcatcaagagggcaagtcacagacaaataaatctctcttcagtggtagaggtaacattttagtaagttgagagatggagtattcttattgctccaagatgacactgtgtggaaattggaccaagcttaagctcccaaaagatgcaacccaggatgctctgtccaaatgcatgttctattctttttattttactttattttatttggagacagagtctcactctgttgcccagactggagtgcaatggcatgatctcgactcactgcaacctccgcctccgtggttcaagcgatttctcctgcctcacctcccgagtagctgggattacaggcgtgtactaccatgccaagctaattttgtatttttagtacagacggggtttcaccatgttagccaggctcaaactcccgacctcaggtgatccacccacctcagcctcccaaagtgctgggattacagacgtgagccaccacacccgtcgcaaatgcatgttctattcttagacaggtatattattttattctcatcttctttttatctcttgcttcctcttttcctccaacatgtttgaattaactatgccccagtttttgtgtttccctaggtcatgtcccaaccatgctatttctccagaacttaaacagaaagcttcttcaatggaaggtgcacaatctttctactgcaactcacaaacaacagtcaaaagccctatgccaaaaaaagttatctatgaaaaatgagactacaagattactttttttcagtaataattttgaaatttcttccctaccatcagaaggttctaggacaagcccagcgatgcgtacacttggagagaatagagcagcaaggatgaatgacagtatttttccacactcagcccctacaggcagctcagcatttctttggcagctcccctttaactagaagaaagatggcagttgaccaaacagataaaatacaagtgttgctgagaccacccaggcatgtatcattcattttgaattgactggatcttttccagagggattttgttagcaaagaagagagaggagatggagtataaggggtcaggggcagtgagggaaaatgatgaaataggtgcacaattctatttggaaaaatgtatagacacatgccaaatacaggtaagaattgcagaaaatattttgctgtgatgttagtctcgaaagacctatgaatgttttttaatttattttttaatttacttttaatcaatctgtcttcaaaatttggcattcccaacacacatctcacgatttgagctctagagtcagaaaagttggctgggcgcagtggctcgtgcctataatcccagcacttttggaggccgaggtgggtgaatcatctgaggtcgggagtttgagaccagcctgaccaacatggaaaaaaccctgtctctactaaaaacacaaaaattatctgggtgtggtggtgcatgcccgtaatcccatctacttgggaggctgacgcaggagaatcgcttgaaccagagaggcggaggttgtggtgagccaagatggcaccattgcactccagcctgggcaacaagagtgaaactccatctcaaaaaataaaaataaaaatagagtcagacaaatcagatttaaataccagctctaccacttattaaatatgggacctgaacaagttatttaagaattctcagactacatttcttcatctgtaaagtggaataaaccaattaacagagtctggctcatattagacaatgaagacaaggcacattaaggtggatggatggatgagtatgtgggtggtagaagattctgaaactctggatcttgcagaagaaaaaaatacaatctaaattcttacctagaggaaactgctttgctttgctagttctcattgagagtgtgaaagatttaagtgttcattcttcaggaagggcatgagtcctcagccatcgatattaaaaaaaaaaaaaaagtgcaacttcacctgccttgagtgtttttgcttttaagaactggaaagcttttattgaaatggtggtataggaatcactgaaaacctttatactggactctgagctcctcagatagatcaatttcactctaataaatcaaacctttgaaacctgctctgtgatattgcagtcatctctgcctgagctctgtggcaggcagagtctggcccagccatggggctggtcttccatttctatttcagtgtaattaagagattttctttctttgaattagaaactggctggcaggaaaaatggtatgggaacattccacagggttctctggagaaacaggcaatctaaccattgatgaagaggacatgggctcatgctaatataaagaaatgctcctctctgcagcaggaaagtgaggagtatgcttcatgctggtgggctgattatttggctcattccaattagtactgaatccaaatggaataatgtatttttccttaattctttcaattctccaaatgctctctgggagaacacattctttctctccaactggaagcagaggattcagctctgctatgaggcctggtgattagacctgttggattagtgatgcctgcaattcagtcagaggtatagtcttcctaattgtctttagcggggttacactccctcccctttgcttccttaatgatctcattagacaattcaatctggaaaatgcttgcaactcctccagcctatgtaattgcacccaaggtggggttttagggctccttcaaacaggtcagatatcatactttgggacattcaaggtagatttgggggccgtctaccaagcactttgagtgagtggctctcactcaaaactacagatgggtaaataatgatagcatccttaatgggcaacaacagaaaaagcaagttgcttaaaggtcatgcatctgcatttaccacagcctgatgcttctcacaaggatcttcaaaggatgagcacattggatcagcaagacttcactcagctttgagggccctgctgtagagagagtcatggatgttccagcagcaagaatagtataggtttcatgcaggcaacactgaagccaggactttttttttttcttttttaaaaaataattcacaaatggtgaaaggtctggatgttaaggcaagaagggtaagggtgggtgtatgaaaaagagataggggttggattttaacataacctttggggtaaggctatttaatgagcatttaatactggtaggttaaccaaatcaagaccccgtttttttttgtttgtatgtttggtcctttttatgaagttatccagaaggaggtactgcaaacattgtcccccaggcagggaaataaggcaacgccgaatgatttctcctttcaaccttaattacatgtctgcttgaattaaagacttgtaactgaatttgatggctagaccttgaccttcaagaatcatatactgaagattttttttagctttattgaggtatagttcacatactatataaatttccatccaaggtaagcgtaaggctcaatgatttttagcaaatgtatgtaatgaaatcatcaccagaatccagttttagaatacagtattatcatcatccctattttccttgtgtccgccaggagttaatccttccaccctcctcttagtcccagcccagacaactactaatctttactttcttacagattttcttttctggaagttttatataaatagtgtcatataatatgtagtcttctggcttccttcacatggcataaggttttggagattcatctatcttatagcatttatcagtagctggttcctatttcatggctgaaaagtgttctgttgtatgggtataccatattttgtttatccatgcaccagtttatacaaattgggattgtttacaacttggggatattataaataatgctgccgtgaacactcacatactaatcattgtgtggacatgtttcagttttactagcagtgaaattgttgggttgtatggtaagatacgtttcacttttaagtaactgccaaacgtctttaagtggctgtaccttttacaatctcataagcagtgaatgagggttccagttttcctacatccttgtcaacaattgtcattgtctatctttactatagctattctagtgagttgtatagtggtatcaccttgtggttttcatttgcatttccttaacaactaaagatattgagcatcttttcttatgcctgttagccattcatgtatttctttggtgaaatccctctccgaatatttggcccatttcttaattaggatttttgtctacctattaatgagttgtgagaattctttatatatttggatacaaattttttgtcagatgcataattttcaaatattgtctcccagtctgtggcttgcattttattttctttatggtatttttgaagtacaaacatgtttaattttgatggcatccaaaatgacaattttaatcttatatatcatgcttttggtattgtagttaagaaatttttgcttgcccaaagtaatgaaaattttgtcctatatttccatctgagtttgatagtttttgctcttatgttctatgagtcaatttatatgtatcgtatgaggtaagagtgtaagttaatttttgtttatttattttacatgtggatatctaatggctttagtatcatttattggttagcttttttcccattgaattatacttttgtcaaaaatcagttaagcatatatgtaagaatttattctaatctttgattggtctacacttttatgcagtgcttgctgtcttaattactgtagatttatagtattaaaatcaaagtcctccaaattttttattcataataattttagctattcttggtaattttcatttcaatgtacattttaaaatctatttgtcagcttctacaaaaggtctgttgagattatgatatatatcacttcgaatgtataaatcagtttgaggaaaattgtcatcttaatattgaattttttaatacatgaataagggtggttaattttgttaaatcctttttataggcagtgattgagatgactgtactctctttgtcctttatactatgcactgtacacaatacagtgtacactctattgtttaccgtatgaactgagttgtgaattttaaaccaaccttgcattcttaggataaatctcacttagtcatgatgtacaatcctttttttaatgctttgcccaatttggtttgctaataatatgtgtttatactcatgaaggatattgatctgtattttactttattcttttgatctggcattgttagcacagtgatactggccccatatattgagaaatgtattctccatctcaattatctgaaagagttggtgaaagattagtattatttcatcttttttgatagagcaccagtgaagccatctgcgcccagggttttcttgataaaagaatacctatttactaacttaatttctttacttgttatagatatatttgtattttctatttcttcatgaatccattttggtaaattgtgtttggtaaatctggtaaatatttacccattgttcattctctcaatcctctctcataaatatgtatatcttttctcccaaacctgctaaatatgtatgactctattgtgtgacacagacccagtgaagcataaaagccaacttaccttcttccctcttgaaagaaagagcaccttcgacacatgcctgagactgtctccttcagtttgcaaactgatattgccaataaaactctcttttctatttagccagcctggtagtcttttggatgacaattacacatatacttagattttcttttcctttttgtctcttcatgtggatttttaccatctggtgttatttctcttcaacttaaatgactcttcagtatttcctgtatgacatctcagctagaaaagcactctctcaagctttgattgtctggcaatgtcttgttttcatttttgaaggatagtgttcctggatagttgacagtttttttgtgtgatcgttttgctttcattgctccgagcatgtcatttcactgttttgactgctattgtttctgataagaagtctgccattaattttatattctttttatctgtacataaggagaaattctacttgtgtttggcagtgaacattttggttacaatgtgtctatcttacttagaatttgagttccattgtcttacagattactacttttaatcaaatttgggtagtttttttttgttgttctttgtttgtttgttttgagacggagtctccctctgtcacccaggctggagtgcagtggcgccatcttggctcactgcaacctctgcctcccgggttcaagcagttctcctgattcagcctcctgagtagctgggtccacacgtgtgcgccatcatacctggcaaatttttgtatttttagtagagacgaggtttcactgtgttggccaggctggtctcgaactcctgacctcaagtgatccacccgcctcggcctcccaaagtgctgggattgcaggcgtgagccaccacacccagccaaatttgggtaatttgtatccattactttttcatattctttttctggcctttcttcttcctcctttatctgagtcttctaaaatgtatgtattgacaccctttaagtttccattttttatctgttattactttttattctctgttcttcagattaaataatttctattgatctatctttaaattttctgattatgtcttctaacattttaattctactattgagttcctttaataacattttattttagttattatgttcttccactccagaatttttatgtggttcttttcataatttctattgcttcattgaaattaatcatatttctctttatttaagcatagtgttgtttagtcctttgaacatatttataatggctactttgaagtctttttctgctgagttcaatctataggcccactcaaagacagtttctaatcactgcttgttctttcacttttgaataagggtcatactttcttctttctttgtatcagaattcttactgaaagctggaaaattgtagataatgcattgtgctaaccctgaattctgatatgccttctctgcccaatgatatttggttttgctgcttttgttttgttttttggtaacttgctttgactaagtctttgtcatctgtttccccttcataggtggctgctgttgtttctactcaagttttgaaaatttttgtttttgttttattcatggatttttaaaggccacgcagttatgcatagcttagtaattaaacaatgatgtttgagaggttgcactcaacctctcaatctaacaagtctctaccctctgccaacggatctgtgtatgtgttggggagcacagtcagacccatccatcttttaagctggctccagattttattttttgcacgtcctcttgcacacgtatgcagacttggagtcagacagtgatgtgtggataacttagattatcttaagtctaccttaaatgtgtgcacagctttccagtcagctcaggactggtagaaagcttaccgaggccccttccagctgtcttgcctcccaggtttccttgttcagtttctggctggtctgctgctttattgcttgatcacactaggtcctcacctcaggcttgcagagagactggtcattcattcattccttcgtgacagagatacctataaacacggacaatgctgcttagtgtggggtgtttttttcctgcttgctataaatcaggtcaatcctctttttcagtgaagcttctgtttttcacagactggacccactctgttagaactattatgtcaattgagtgggggacaggaagtgggagctacccacagcaagaatgccagacttcccattttcccaccagaagttcagtattgttttaaataactgctcctcgactttgtgtatgcatttggttgatttccaaagcctgaaaatggtttttattttttagtttttacttttttctaattttgtagctgattttgaaggagagaatttgctgagctaaaaactgtgccatattagaatccctgtttcaataaattattttggaaagaaggaataggtgaaagaattaatgagaatgtaactatcatactttcctcattaattagacatgaaattctctgctcatttctgttatatggtatcacatcccttcatcatcttgatccatatctttggttacttatacccctttataatacatggtcccaagaactaaacataatacttcaagtatggtcgcagtcattcaagcagttgtaacttatctctgtagaatgggttacctaagactatatcatcctttttccaataggcagcaatgagagttgagccttttaatagattttgtttgggctctggctgatgatccatggtagaaaaacagtgagacaaagcattagactaaatttccatggaagaaatttggaattaatagcacaaatatatttatctttaaacttttttatggtagcaatatacataggggaaaaggagattgtgataatatcaataatagccaatatttctcgagtactttccatgctccagatacaattttaggtgctttacaaattaccaccccttttatcttggcaaccctactgatgaggaaactgaaatcaactgtagtaaagcaacctgcctaaaataacagagctattaagtggccaaactggagtttgagcagggatcctctggatccaatgctcagtgttgattgaatatgcagggctactcactgtctagtgaggagagctttctcattgaaagctaatctgagcatgccttgcttatccatcgccagttctgaaggagattgagaaaagattggtgctgtaaacttctaaatgattccaatctacagcacatttcagtgttgcatggtttcagtttatgcagctttctctgctttgcctcagcaaattgcaagtccctcggaagagtccctaagaagcagttcctctggctgctgaagcggccaggctgctatgcacgctgggatcacattcggcatagtaagtagccattccttctactagaagacctgcacacaaatcagcatggggctaaataattcaaatcagaattactagcagctattgaatctgagggcatttgctaagtagaacaaagagctatgaaaataaggtgatggctttctttctttctttctttttttttttttttggctgatcttatgccaatcacaaggaaaatatcagaattgcaaatcatgtgagaataaaattgcccaaatcctgatggaccttattatggataaaagtggaattatatctagaatagagagagtagcagctctggccagtttctttcacaggctccagaagtgacaggcatggcacagattatgccaggcttagtatctgtgctccgcaggggcgattcccattagcttctgtgcccagatcctcatcctaggcagcgtgtgctgggtagcattcaggacagcaaggttctcctgcctcagcaacactgtgcttgctttagaaacagagtgagtaaggcctctgtcgacatcacgctttaattttaatgagaagtcatagaaggagctggtctttttggtcttttacaatttggaaaataagaaaaaaattgttaatctttccattcctatgctgttcagtcattttggcctaggaactttaatgctattgctttgtagtttccattgcataaaggtagtcacctatgtgctggtgtgttgctcaatctccctcaacccaatcgcattcaatggaaatgataagagaactctgttcagctgtttcccatgtgtaaaacacctatttagtggagctgaaatgtactgataactgggctcaaaagggacagtcattttcaaggcttgataagtagcaagatgtcacattcttgctgccttaggctatggacattacttattcatttcttcatccattattttattaaaaagtgtctgtacatggcatggattaaatgttggagaaattaccaatatgcattgctttatttgacttcccagtcttatctctgctcctgcccccttcctgtttttcacacatttcctatagcaccgactacatgccattttataaacagatctttgccaaagaaccaagtacccaatcgtcctcacaccatgggtgccccactgcgcccacattgcctgtctttgttttgtttgctcctgttccagataattctttctgcatcaaaacccatcttcctcccaccctcatttcctctgggctctgccaaacattcttattaacacagagaatcattattgatagggttacctaaattaaccttgaccatttcctttaactataaaatgggagtgataagaatacctgtatgatatattgttgtatggcttaaatgagataatagaaatgctgaaaaaaatacttgtcatatagcaagtatttacttactatgctgcatatcatgtaatcattccaaaagctaaaaaacaaaacaaaacaaaatgaaaagatagtttccttctggtcaacattgatagtaataggtaatatttatattacttagatactgtgtgaagcataatattttattaattattgccatgcccattttattgataaagaaactggagtataggaaatcaataataattttctgccatcacttctataatgcatttggagaggctttttggtcaattattgaagggactggatttataagttgctttagaccttctgattaagggtgagtgatgtcaccaatcacagcaatggaaagatcacttgctcttatcccttctaagtgctttcctgatagcgtcaccctcatctactattttgggaaagagggcaagaagtggaagaaaggagtgctgcatataaagccctgggagaaaattgaaagctggacctatgggttctctgattcctgagactataaatctctaggatttggggcaggaactgattctagctcaaaaccaagtctactagaactggctcactctgcccacctaaccctgtaggagggggctttaaacagttttgatgggggcaaacagtgaggacagaaaggtccatcacctggtcaagaacacagcatcattgctcttccctgggcattgagaacaggaggtctgtttgaaatggtaagatatatatcaaacccattcagtgggcacaactttctgtatccccagaatttcctgaaaacatctttattataagagcaagtttttccaataaaatctgcaaagattagttctatctgactcatgaaacccgcaaattcttccatcctcagagtctctagagtggtaactagcttgataaataaagaatctgggcctaggcatgggcagtagcaggaaagaaaggcagggcattaacttgaacctggatggggaaggcatggggatggtgagcagtggggtccctgagaagtgtgcacacatgaaggatgcaggagatattctccacgagttgctggaatggccaacagagatttgaatttcatatggaaagagggaggtagtgggaagttcagactcattgtggtgaatggttttcctgcagcagtggcaggtttttattttttattttttattgtttagttgtaaaaagacgactgcatctgttttgctcaccattgtcatggcagctactgcaggggaactactacataaacactgttggatggatgaatggatggtccatgtattcatccgtattcacactgctataaatatactacccgacactgagtaatttataaaggaaagaggtttaattggctcacagttccgcatggctggagaggcctcaggaaacttacaatcatggtggaaggggaagcaggcaccttcttcacaaggggcaggagagaaagaagtgcaagcagagaagatgccagacacttataaaaccatcaggtcctgtgagaactcactcactattgtgagaacagcatgggggaaactgctcccacgatccaaacacctccctctctccacacactgagagtacatgtccctccttcgacacatgtggattacaattggagattatatttgggtggggacacagagccaaaccatatcagtccatttcctgagagtctcctaaatcactttacgacatcccctgctatctggaaactctattctgatccacctgcaagcccccagacactatatagattatgtgacttaacactgaagctgatctcccaatgcctctttttgcaaggtacattatcttcatttaaaaatatccttcctacattccttgaggggttctaaatgccccagggcttttttcactgagcaggcctatggctggttaccccaggtcaacatgtaatggagggctcaacaagccatcctgtgaacctctttcctggaagcagggaagaggaatgaggcaggctgctatggagtagatcccttatctcctacctagaaggcatcttgcctattgcaaaggtttgaagcagtggctctcaggcctggttgcatattagaatcaactggggaacttttaaagtgcacagacttcaccctggaccatttaaatcagaatctctgggcacgaggctcaggcttcgttgtttttaaagcttcccaggtgaatcatttgtggtcagagttgaaagccaatgagtttttgttcttcaactctgctgcaattagaatcacatgggaaagttccaaaaaaaatctcaaagcccaggccacaccccatgccaattaaatcacaatatctggggtggggccaaggcatcagaattctgacaactccccagatgaccagtcaagttttagaataagtagtttaggagaaaacaaagatttatttctccttggtatgccaaatcactgttatttgctagttgaatgccaattaaaagcactgatttagacctttgaccaaaacaatcaaaatagtttcacacgtctaatgctcatacaagatccacaaataagcattagcaattaagcaagcagtagagagctaattaccttattttttatatctcgatttctagtcatcagaaataaataaaattagctattattgctttagtgctagatcctcacagcaatcttaggaagtagagaatattattccaattctacagatgaagaaattgatctttaaagaaattaaagaacttacccaatgttgcccagggcagaagagctggaatcaggatctgcactacagaataatgacaccaaagcccgggctctacttactacacttggctgcctttatttttcagagctgtattgaaatacaatttacataccgtaacactcaactttttaaagcatgtaatgatttctaaaaaatttaccgacttgtgcagccatcgctacatctagttttaaaacatttgtcactctcaaaagatcgcttgtgcccatttgactggcttttaaagaacatcggactaaaagtctgaaaacctgggttttactcccaaccctgtcatttacacagtactatgaccttgaagaattccttaaccttactgggtctccgtgtttttttaattagtcacttagagataataatttctgccagatgataaaggtcaaagaaaatattgcatagggaaatgctcgatacccaagagccgtaaaagtggaaaggacagcaatttttttttaaatatgcagaaagtcattttgcaccttccaagtaccttgggtctgaaatggcactgagagagttgcaataacacaaatctagctgtttctccctcctctgcattttccctctctaccaactctgtcatcccattcacggtgtctcacttacactcctttgggaggtcaaaatttgcactagccatcttagttgatgggggtgtacatccctttgtatcactggagtggtaatggacatgtacaggccagcgtaactcagagctctgcttgggttcttaggggcttagctgtccctggcagaagcctgatatgcccatatgctcctgtaatgactagctgtcagggagatgcatggtgtcctttcagcagaagaacacaaacagatgaggtgaactgtggtatttctctggctccttaattagcactctgatgggtgacaggaggcccaactggatgtgttccatcagggctgcaggggagtcaagccaaaggattatgatgttcatctatgtcccaaataaacagtcaatttggagccagtgttacatgcacacaacctgattttatttccattttttcatcctttgcctgagccagttttctaacttttggtagtggagactagaaacattctaagggtgtatcttcttcagccttataatttattctagcaaaggccattgataaatgttcactgaaatataaatagagcttgactcttcatgcaattgcttacctgttcctctttctccatcttgcagtatctgggtcttatctcctgtatagaaattctcagactttccgcctagcagctcaaagaccatcactgatttttgatgattcgcatgaaaaacattacatagttgcaattcgttcccctcaactgccctcgatctccatcactgctttttgatgacttcagtgatatcttatatagttgtgatttgctacacccccccactggtcctagtttagtggcccatctggcatgcagaggagatgagaaacttgtcttctgctcaaaggttaagggcacgcagagacagggaaatatggggaagaaggacctgtgatcttattgtgatgctgttgttactgcatcatttttaccagttttcccaataaagggtcaaggtctaagtcttaaattcaatagcataaattatatatattcagtggaagattccacactgatatttaaagttcgtttccacgatgttattgggcagctattatgtgtgaaacacagggggagggggtagacactgaagaatacacaaatctgataaacaaaaagctcaagtagcttagtataaagccaaggagagccagagcaccatatgtttatgaatataatggcatttctaagagtgcctcttgagttccagggcttgaatgatatgtgtgggtcttcctcatagatttggggttaagcaatccagctatttctcactgtcccagtagatctcttgctgaatcactggaacatggcatccacgtgggagaagtggtgcttcctcctcctatcaggcagatttcagtatccccagccacaataagaagcaggaacagacagctgcacagggaaaggcaatggtgatataaatacatgtttaattgcacatcaattacaattagttactaggctgcatttatttaaatgcagtgtaattagagcaaaaaccttgatttaatcataaccttatcaaacacagatcccgtcatcttcctgtgctcgcagtctgtgtttccctctgctcaattccaaggggaggggagatagcagaatccatttatggtagaggcctttgccaaggattctctcctcatctgggacccctgctcagatctgcagaggggttcatcgtgtcgtcttctctagcagctcctgatgagagggtctgattagctagaatgatttattgaaaatataactcatccctaatggcagcctttaaaacccgggagctcaagattagtaaggacattacatagcttcagcctccagagataaattactccttggaatgtaccctctcacagtccctatatctgatttctcatcagtgtggatgggctctgacttgacatttccgcaaaggggtggacagcaggcaggccgactgtctttcacagttagctccaggctatgtctttgtcctcctccctttctctttcattatctcctggcttctctgtccctgcctccccagaggctgagatgttatctgtgagttttttgaaggagaaagtcctctttctctgagtgtgcttagaagcagggctctattgtacccataacagcacaaatatccccaattgctgggaggtcttttcttcaatgatcttctccatggttactgggagataaaatggaaaaaaaccttatctacattttatggattggaaagtggaggtctagatctaagactaagctagcaaagacagactgacagaaataggcaaatgtctttgtgaagcaattatattgcttatggttccttcacacagttattccctacactttctgccaaacagaaacagatacatttctggaactttggtattgataaataaagtgcattgagcatccactctgcagcaggcactgtgtgtgcattgtccttcacagcaaagcacagtatagccaccattattatttccattccacagatgagaaaactgatgtgcaaaaaagttagttacctagcctgagtaacgcaatgaccactgttgtctgtggaacataagcttagagccagaactgcattacacgcttagatattttgtttcctcttattcttgcaacaaccctatggaccaggcatcactgtactatgctgactttgcaaatgaagcaaatgagctccaagtggtgaagctaatggcagacattttcatgactagagagtggtgaagcctagttttgtcccgaagtcccatgtgctctcttctgtgcctacctggtcttcttccagtggtcctacgtcccagctggtgacaccaccagccacttagctgcacaatccagaaacccagaccccagactgaaaacccctgtcacctgccacattgtttctatgaccaatttctgtacgttttatgtgcttaatccttctccggtttatccatcccccagccagcatgctgtccaggccaccattatctcctagttggattcagctattactgtccaactgggaaccctgtttctactatctattccctacgtgtcaaccacagtgaacttaaaaactgcaaatgtggtcatgtcactcactggctaaacccatccatcagcttcccatccttccagtaaaggccatgatctttctcatggcctgcgtctcttttcagtatgggattctcacccatcccatatctcgagcccacatccatgcctccttgctccagccatgtggccttctttcatctgttttcacatggtctctctcaaaacagaggcttttcccatgtgactccctctgcatagaatgctcttcacttcgccccacctgcctctacctggctaactattccttactttgaatctcaactcaaaagtgacctctttatggaggccttccccgacccttctgaatagatcagaacctcatatcatcacagagagtagtcatttgctgtttttatatactcatgtgactctttcattcagacctggctccgtactaggctctgagatgcaggagggcaaggacggtgtccgtctcatttaccaggacatccctggcccccaggatggcagcctgaacctagaaggtctcaataaatattcactggcatgatgagttaatccactccagtcggcctggaatccattctttcatttatttctctttggtgtcttctgcattccacaagctctttcccacatcccacaactgagtcttttctttcacaaatgttttcttggcactgtagttttgggctcttgcttttatgagcccttaccagaatttttctttctttccagaatagtctttctagtttctcttcttcactctgcccacgtaacaccttatatccactacacacaggctaagctcccctgataccacttttacaaatagtatgtaaggccatgctggggatacaatatctgtagcacagattcaacatacacctcctggagggggacatgttcagtgctataagagggtatcacagaaaagaaggcaaaagcttggaatggaaataaataattgctcagaagaagaagctagagtgaagaaaagtattggaaaattagatataatagggacttctaaaactcagtgtcatggggccttgtggaacatcactgggagtttaccagcccaaagcgttattcctttaacactatgctgggcacaggactaaatactggggccagagaaaaacaggagacagtttctgacttcaagcagttctcagttcacacctttcaggtggtgtgtgtgtgtgtgtgtgtgtgtgtgtgtgtgtaagggagcaggagactggtaactacaacatggtaattatcattcatccattcattcagcaaacattcacggacaacctattatgtccaggagactgttgtaagcactgagacataaatgtaagcaaagaaactaacccccttgctctctaagagcttacatgctcaggagggagttggggtaacagggacaggctcaagaacaaacataagtaaaatctacggaatgttggaaagtgctaactgtcatgaagaatcaggaaacttgggtggggtagggggatggagtgtgtacttgtatgtgaattaaggtggtctagataggtctaaaagactactgcatgtggactccagaccactgtgtctttcttatcaggccttcttctcagttgtattatctttaatccttgaaacaactctaaaagttaaatattattacctccaccttatggagaagaattagaacctcaaaaaaggctacttacctttcctaagctcatataccttccaaatggtaggacaaatgctcaagactaggctcaactgctgcccaagctcagcactagcctgttttgctgtgctgctgttatattagtgaaagcatgctccaaggcatatggaatagggaagagttaaccctaattattgcattggagaatgtttctcagaggaactaatatatgagtctagctgtgataaatccatagatggatgtttccagcacaactgatcaccctggatgccagaaacggctctagcctcaccctgggcaaggcacttcccacaggcagtgatgacctagacattcacatctgtgcaaaggatattcatgggcactaattgagcattagtgtgccaggtgctagggtgtaaacatgaacagggcagggccactgagctaaggtgaaaactcctcttttaataaaagaatgttgtcatcatatagaagtagtgtgaagttgagagtggcctttaaccctcttccccttaaatctatctcccatgaagagtactgtcccataaatccatgctacttgggatgctgtcctttgggttcaaaggttgctactatcaaagcttttagttttggtaaggcattctgctatctggacaaatgccattctgtaagggtgccgagaacacacggcttgtcacgagaggcttgaccagctgcagcaggtctggacgagtcgccttagaaatcatgaaggagagagtacataagaagtgttcatgtgtggtggggagcactcagaggcatgagtgcacatatggaagaagaatactcacacctcaacaccttggtattctagggacaatacatggctttggagtcagacatgcttgcttcctaattccatctctagagtttatcagctgtgtgaccttggacaacttaaagatactgtcgagtttgctatccaaagtgagatgatgagacttcccactgaggattgttagccagaggattaaatctgaagttgaaactagttgaacatgttcaggcatctgatcccaagttttgcctaggtctagtctgattcaataatgtctttttgctatactttaatgattgattttggggcggaatatctcaaagccctacgaacctaacttagtcattcaccgactgtaaaaacggtgaacttagggcaagttaccaagcctctctgagcctcagttttgtatctgtcaagggagggcaatgaagcctcccctgtaccatgttttaggattacaggagatgacgcatgcatggctctgagtttagtgcccagcacatggtgagttctgaatagactagacatagccattatcattattattgactataacaactacatcaagagagccagctccccttcattccttttgtgtcagaaatttgctttttctctttttctcctggaatatatatatatctctttatatataatttcatatatatatatttatatttatatacaatttcttcctctttcctaccagctgagaagtgagaaagagttaactgcagtcataaagcacagaggctgttcattagagcctgacttataaatgttttacactgccatccagacatgttggtactacacgactacaaattatgctttggtgccttgtcccgcagcaggggctgctgttcaacaatcaagcccaaggagcttatttttggtagttcctgccatcagtgatccttcctttcctctgtgagtaagtgtgtgtgtgtgtgtgtgtgtgtgtgcctatgaagatacacatgtgtctggatgagcacatgtttctatgtttctgaaaatgttaacagagccaccacctaccacagggaaatctatattctgcttgcacctatcatgggcagaaagcaataaggaggtgaaagaagttgagggagaggctttttgtttacctaccccttggcttctggctgctcttgtgcctccccagcccaggcagggggcagcagggatgtgggaagctgtgtcagtcttgcacctgccctagatcaatgcagttccaagtgatgggccttcttaaggaggtcgcaggggtctgttgatttcattgggtggatggaagggcactaatgaagttatttcacctttttccaagctcccaggcactcctgaaggtcactgctcccaaattttttctagggaattctgatccccattgaaggtatctattttctcttcagtttcattcaaaggtgtctatgatgcaccaaccataggcaataacatactgtctgggtgctgtggggaaagcaaaagtgaactagatatgatacctgccctcagagagcttgaaatccagcagctacaaatgatgatgttaacctgtattgagctcattcttcaatgtgctatgttctaaggactgtctcaagaacagtttctcatttaattctcaaaatcttttgagttaggttatgttattatccctattctattaatatgttcaatgaagttcaaaaaggtttagtaactattccgactacagggagctagaatatcaacattcagagcctggttttaaacattattatgagtgtgaccttggtaacttaaagttctctgttactcagttttcccgtttttacaattgcataatgatgttatctacttcacagagctgttgtaaggataaaacaatatattaggtatttaatatgtgctggcatatagtgaggacaccaaaaatgttagctgttttttaaaacattgcctcatcaatgtcctcagtatgccacccatactcctgagaagagactgatgtgtttgaaatgtccaaccctaaagtatttatttgtattcatgggttaattgtcaggtttatccacaaagtcaaaccaactatatgtcatcagctatcacaaaaaataaacgcaattctgaagatagcaatagctcatagacatcaggtcaaatctgcaaagatgagcattgtcctaggtgctaaggatactgcaattaagagtctacatggaacttcagatttagaaaaactagggttggaatcttgctccctgttccttctgcttgtgtactcttgtccaagctaccaacctctatagcattgctttctcattttatgaaattggaataacaacagtacctacttcttagaatcatttggggttaagtgacatgaaaaacacaaaccatagtctctacgcagagtaactgcttgaggaatgttacttataggtcattgggaaagtgtattgcacagagaaccagcatttataggcagaacacataaattataacttacttaaaaatctacaacacaacaaaactacaagattagtattactgataagtcctacagataaggctgctcaaattgtttatgatattagcccaagggtgcacacctataagattggatatttaatctgaatttgtatatccttaattcaaagttaatgttcttttcagccaggcatggtggctcatgcctgtaatcccagcactttgggaggccgaggcgggcggatcgcctgaggtcaggagttcgagaccagcctggccaacatggtggaaacccacctctactaataatacaaaaaattagccgggcgtgatgacatatgcctgtagtcccagctactcggagggctgacgcaggagactcacttgacctgggaggcaaaggtcacagtgagctgagatcgcgccattgcactccagcctggttgacagaacgagactccatctccaaacaaaaacaaaaacaaatacgaatacaaaaacaaagttctttttaccattttggccacaagcatttacgtaacagctattggttgtgctgaggatatacatacacgaggacatctatgaaattatcagaagaggaaagcaagaaggtggatgtggaaaatgcactatgtaaggaaaagagtcctacattaattggaccaaacatggtagctagaaacacaggtacttgctgatgaatatgggcaaaaactgtgagaggatggacaaatgatttgccaataggcttgctgagggtagaattagcagtccagggaagcacgtgctaccatgctgcaggaggtaaattactctactcactagttagaggttcgaaaacaattagagagatagattccatgcgtataaatagaaagagcatgtggatatatgggtgctgcatggtgatagataatgccatagataaatactggagctggaaaggcatatagagactccggataaatgattcctataaataagaattgctcatagatatttcagatgcttctctatttatgaacatttgacattcacccctaaggaactgcatatttcctcatcaaagagaaaggcaaccgtgaagccaatgactggatgtctgattagagctttcagcattcacaccgtgtgagcagctgcaactgtgactcaggctctagattcaagcccttgaggcctaatggatgtctcatccacagcatggccaggaagccacagtaatcgctgcctgagaaagctcaccaccagtgcctgttactgggctcagttttctttggaaaaaaaaaaaaaagccctcattttcccttgctgtgataagtaagagaagtcaccatctcttgcttgaggcaaaggatttggtctgggtaggtattgggaagtgttcctattgtttattagatgggactttccctgtgagtagcaagcatttcatattgtaaatgttggaacattctgtatggatcatgggcataacaaagtaataatagcagaaatgtgatcatatctgtgcaacagcttctaaaggaaaacacatgggttctgaagtcagatggaccagaaactgtgtgatactaaagaagttacataattaattgtccttagtcttaaaatggggattataagaaccatttcataggtttgttacgtgaagtagatgttatagtctacacaaactacttagcctagcacctgggggatggtagggtttcaacaaaaggtaattgatacaattattaacaatgaccagaacagcaaagtcccacctgcttgtccccagtgaaggcatacttgtgtgcacagcactttttactacttaggtagcacagctttgcataaaaacagaagccaaaacacctctgaaatagctgccagaggctctttctcttgagttgaatgtaagaaagaaggcatacttgctccctaggtcagcctgacctgcttgaaaacataatccaagcccagagggacaccagagcctatggctgtgagttgtagaaataaatattaaacagcactctgatttctagttatttttccactaacttgcattgactcataggaaaataccttgaagccttgagttttcccatctaccaaaaaatgtattgaaagttcgctttactcaggcacgattgtaagtactttttgcattagttcatatcacactattagtaatcttatgagttaagagaattttaataccttcatgtcatagataagaaaatggatatgcagagttgaagcaacttggctatggtaattggtattagagctgagagtaaatcctgggtcatcttactccagagcttgccttcatactactctactaagctacctccaccaaaatcaagatgttgatctcactgaagctttaagctccatcttaactacaaatgtcatgactctttcatgaatgttttatagcaggaaggcatcaggaaattaagtcactggcatagacttagtggagcattcaacaaacacgtgttcaaagagcctaccaggagctaggcgtcaggagttacgatgcacaatcaacggtgcagcaagtcgccctggatttcataccactgtgctatggatgtctatgaaagcattctgcaatcagtcttattggttggaatatgatgtagcaaaaacaaccctaaactctctccatattttgatttttcagagcacttatcacaataaaaaatcattacgtttgttttcttgcttattgccttctttccctttaccatcctgatgggaatatttgttctccctggagcaggggtcttgttgacttgttcgctgtagaatccctggtacccctaagagtgctgatccatcgtgggagttacataaatagctgttgggtgaacggtgaatgaacacaacaacaataaaccctagtataacactttacatcatttcactgaagtttaggaaatgcttgcagatacaatattcaatttgatattcatcgacagccctgtgggagagctaacttgcattcctcattttatagaagaggaatcagaaaaatcaaagaggttatttgaattatccaaagtcacaagtgtgaaaactgcaaccattttgactcaaagccccacgttttgtattctgcaagtttgcaaatgaaactgtgacaacattttggaggtaccctttgttgaaactgagcacttcagaaacacaggcccttggcataattggaccggaggagtgaatataggcagaaagaatcaacttctgccttctcagttgtatgatagtcctaaagaaaatggacagtataaatagtttaagcggatgacaagtttagataaaccatgtttcattttcttaactcagtataactgagagaaaaatcccatgtctgcagagctaatcgttccattttcttcccaaagcacaaccttagcttcatccactaacacctgatgtcacagcatgttataactcagcagagtgctatacactgtgtcaacctgcgccttcattttttcccagtccctcatctgaagtaaatggagtctatgtttagcctatctgtgttcagatcctagctctccctcttcctttctctgcagctttgggatgagtagctttaactccctgtgcttcaatccttcacaggtttatgagaagattaaatgagttaatgcatatgaagtgtttagttctaggtctggcatataaccaagtgcttggtatcttttagctgttatcattatcattttcattatcattctaacatccagatgaccttgcctcagccatctttcccttccccccaagttgcactgtaagaaacatctttgtcatctactctgccattctttttggctcccttctaaattctcaaaccacaatttcctttcatcataactctgaatataaaaataagatcatttttcttctcataactggattatgactcaaaataaacattccattgaaggaattagaaaagtcatcttgacaaatgaaggacaatgggtattttaatagtgaccattatcattgcctatataccatttcctcaggtactattcttgaattgttggttggacttcagttccattgatggcctgagccatatttacttcatgtcgctatggcattgatcacaccctcaaaggaggtatgcaaactgtgatcttgtttctgtgacaaaaccaggttgggggaatgatggttaatacaacagtcatctacttcttgcataagtctttcagaaaacaattattgagcacctactctttcccaaaggaggcatttttctagatgctggcaaatcaacaataaatagaatactacctctggccgggtgtggtggctcaagcctgtaatcccagcattttggagggctgaggaaggcagatcacttgaggtcagaagttcaagaccagcctggccaacatggtaaaaccccgtctctactaaaaacacaaaaattagctaggcatggtggtacatgcctgtagtcccagctactcagggctgaggcaggagaattgcttgaacctgggaggcagaggttgcagtgagctgaggacagagcaagactccatctcaagcatttgttaaatagaactatgcttagtccactatttgcccatctgacagagactgtagaagtcagaaaagcttcccagagaagagagtatcagtagagcatttgcaagaatggattgaagttaggcaagatgcagaacagaggtcccatttgattaactaatgtctgcaagggcatgagttgagatggtgagacactcctaggagacatctatcatatcagtgtggctgtggcatggagtttgggagtggagtgagtaatgaggaagaagaggggtcatgtcataaacacacttgcatctcatgctgtcaggacttaagctttatccttttcttgggggtgggggaattgtatttcacaatcataaatggtaggtacaattatagaactcattgaaggtttactcagccctcattttttttctttacccacgttggtcacagcataacacttccctcaaaaccacacttgatgtgctggtacttcaattttccttttgccaagagttgacattatgctaactttacattttacaaatcaactcacctactaggtaggagagaataactttctgcgttttgtggtacatgtttccacttactgcttgccccgaggatgagggattctgtatgtggcaggagtgaaaacaacagtttttttaaaaaattaagcattaaattacactggacgtgtttaattttgttttcagtaatgggctttgatgctttggtgaagactcattgtgttatacttgaaatagaaacatgtcatgtgagtgaacctgtgaggcggggagaacaataaaatggcaaaatgcacccggactaggtggggcttatagtgctagatattttaggctcaattttattgttcatggcactgtgcaaaaataaatagacatttaaaagaagtaggatatatgttggtatgaaagcagagggaaatcaattagcagctgtaacttaaagctgaggaaatggataggattgactttaaagatctgaggtactaatttgtctccttaaatgcaaatttctaagtttatccatggccgtccaatatacagatatcccaatgaacccagattattttataatagggaataaaggaaatagcaatcgttacagagaggtgagcccttattttggtgtttcataaatgcctgaatccagatcatatattggggccatgatccaagagatgtcagattgtgtatattttacagtttttcaaaataaggaattatcaatgtggctaatccggtctgtgagaggtcaggatgtaacatcagatgaagttgaacatcggtcatcaggtagagttgaagacacatgaaacgtacatgaaaaaaaacatgaaaaaataggcaagaagcaaaggaacagccatggacgtagagtgaagatgatttggtttaatgggtcacaagaaaagcttcaaaccctgtgaggtcgccagaggactattcatatgtggcactaactgtatagcacaaagcttgcatatagctaaccaagccacacaagactgtaacctcttgggtctttctagatgagaagtcttgtttatatagcaattagaaaatcctttatgacttttagcaccaagctaagggaattctttcaggtttagtgactagaaatcatggaagaaatgtccacttccccacaagggtgttgcacaagggacacattcaactatcacataattctaagtactttcgaatctagtggtttaaaactagaaattaatgctttaaaaacataggcgtgtaaagcattcgtgaagaggatgttgtaacgaaatatgactatctagaacgacattaaactgatttccactcaccctgggaattcattaaagagaaaatcttcattctgtgacttcgcactgtctggtttatatctgggcttatgtccaacaaaactactaaaaagtaaggcctgtgaaccactagtagatattggtggggtgacagaaattaatggaattgtgacatgcaacatgttgaaaaaataaaaagcaatctcaaaattggaaaaaaatagaatagaaacaacgggtatgaattaaactgcctgtgcttttagtagaagataatgaaagaaagtggcacgtccaccttggcttacagctaggacattcccaattcaaggcctttaaatcaacagcttcaaggaccaagcaaaggcatcattttgaaagaatttttagggcatttatatactagctgtcaactgccttggtggcagggtgataaatgcttctgaatttgagttaagcagactaaactctatgaaactgtgcttgcacaactgataaactgtctaatggtcaattctccaaaattcccactgggtaagacagagaggtgtgtcaggggaaaagctagcatggaggtgggagatagagacacaagtatgcaaaagccaccccccaccgtgtcttcccagtggtccacgtgatgcccacccctgaatgcacaatggcacagctgctcccacccaccacagagaatccagctgcaggtctctcctcctctctgcctcagagccgctcaacatccttggattaataatcatggtcattttcagggctttggtttccttccttagcaataaacatgtagatgttttaatctaagatatggtaaagctaaatgacacactagtgttcaacttccttagagaagaacttggggcacagtctagaagtcatgaggggcatatttcataggatgtctatttagaccctgtagatccgatatgtggataaagcctagagacagagaagaaagtgttaccaaactttgcttgacttgattctagacaaatgcttcctaataatagtaatgataaaataacaataataattattataaccatccctactaccccaactattacacatgctgacaaggagggccatgtaccaagcccttggctaagtacttcacataccttatcccaagtggcccaagtctaagcttgatcatctcttgagatcctttctaccttaagtcattaaattgaattctcattttcctaggaagcttatgaggagacaagcatcattttgttacttgacagtacctggttgcttacctggacttatgtccagcagagctgcaaaataggctaatccattgcccgcaagtttccattttgaaaccattgcatcaaagtcatatctccctccttccttcgactgcatcaccccacttctatttagactgcagggcctttcagaccccctattctaacacacagataaccttgattagaagagattcatgtttataattgaacaacatgaactttctagttaaattgtcttaagatcatctaattggaaaaggaaagaaaagggaactaatttatagccactaatacttaatgctttatatagactaagagaaatactttatctctatttttcatcctcagtttacaagggagaaatctgaggctttgagaatttaagtcacatcttgaaggtcaaataatgagtaagtggcaaagtcaggatttaagcttttccatttcctctttctgcctcagaaataacatttaaaagagaatccatagcctgcatccaactgtggcaagaaaaaagtaaagcatactgcaaaaaaaaaaaaaaaaaaaaaaaaaaaaaaaaaaaaaaaaaagaagaaacaaacacagcaaaagccctttccctttggcatttaaacattgcttgtgtgaaaacatgaggatgaaaattgtacacatgcttacatgagcaaaaatattcctgggagccttgagatttatttcagacatatttcaaatagatatatggaaagcaagaaaggagcagagaaaaaaaaggcatctgatgaataaatgagtgggagaaatcatgaggaaaagagatgcagtgtaatcatggccctgatttctttcaggataaacgggcttgctggtgctgtctatactataggggatacatcatatgtactgagattactatttcatcaaagatgatattggatctgatctttcagtttggccagttggctacagaaacaacattggaattttccaaacaaaattttagctcaagggaatatctaaagtacagattccttagtcgacttgacagagagattgggctagcttgcctttggtgcccagcaactaactgcttagggatagtaactcttatctgtcgctcactatctccctcaacccacatgatgccttcctgttggaaacattccatgaaattagacaaacttatctgagtgacttagccaggaagccagcttaagaaaccaaatcagaaaagccgttgtcattttgcttcctttcttcctcatgatttgtgggtaggagatgggaacagaaaggaaattgtctccagtatccatgatccctagagacatccatctgtcagatatggggcttgctatttcaaagggagtatctatctgcagagaccctcaaaaggatcaagcttgacctcaacctgtcaacctgacaactgtttcaataggaagcccagataccttcacaaaacaagcctaaatgaactccttgacctgccatgagtcatagttttattagatctctgtagtatcattagatctctatagactaaacacacagaatccccttccctcattctcccttcccacatgctctttggcaaaaggctgccactcctgtggtctggatcctcaggctctctcctccttctaccgacttttctccttcctcactctgttcactaagccttaagatggttaactgcctcattgcctcagacttggggtcccctggcctcttccaatggttggatgctttggttcatcttcaggtttttattctggtattgcatacaccgggactgttgggtcacctctaccttcacgctcttcaaaataacacagctctgacttccttccacacctaccatcttggctccaagaactccggagacctacttgtgccaaaagagtttttgggacaacactactttgtctttctacatcatccctcaaatgaaaataaaatgattggttgaattatttatttgaatgattgtcacttgacacatttagctttaaaatacagttacatttagaaaatactttggtacatatgttcacatctgatactacaaaaaccctgtggtattcatatctccattttctcattcagatgagaaaatgctttaagtgatgctgaaatgaatttcacaaattcctatcgatcaacagaagcatatctagaactcaaacacagagcagattccaatgcagttgtgcagccccacgcacacgtgggagctctgtcaggacagctgtagtagtcagatggctgggacagaagagcttgtcgcataaatcacaagcagtgcctgtgaattctcatcaggtccccttgcattttcctccttaatagattttatgaagtcaaataggcaacatttcattgtttcaggtggagaaaattgagacacaagctgatgaaacaatttgaaaatagaagccctgagtcctgaatcttagaccaagttttcctccttcataaattaatgtattgaattctgccgctaatggtattgcaaacccgcttactattattgcagagaaaaatctaaaaatatagacaagaggccgtgggtgcagtggcccacacctgtaatcccagcactttgggaggctgaggtaggcagaacacaaggtcaggagttcgagaccagcctggccaatgtggtgaaaccctgtctctactaaaaatagaaaaaaattagctgggtatggtagtgtgcacctgtagtcccagctactcaggaggctgaggcaggagaatcgcttgaacctgggaggcagaggttacagtgagctgagatagagccactgcactccagcctgggcgacagagtgagactccgtctataaataaataaataaaaagaaagtactttctatgccagttacaaatccataatgatatgtttagcaatcctgttttttatttatcctttccttctcagaaattcaatagcagacttagttatatatacacagccaatgtgaagacacttattctcaaacatgcaaatgttatacacgtcatcttgcttccctctacctattgtcagccttcagtcacagtgtctaccagacaagtcatttctaattagagaggaatctggcatctgtctttgtgattatactctttcagctccaatttgctgccaaaccccaggtctccacaggtgggaactgaagaaaaaaagcatttttcactggtggtttcttttcaaaggtaaagttttcatctctgcaggagcaattaatttttcctgtttaaaatgacagacaaaagtcttatcttttgcttttcacttgaagagcttggggaaggcagtgtgggagcaaaggcatgttggtttttcctatttccctgctgagccagatgagttgatttctgagcaaattctcggtattatataaaggggttagtaatctggttagataccattgaatgccataagatattaataatgagaataaaaattttaagaatcgacttttgttcagcgctttcaaagatgtttgaaaaatctccactccacaatgataatgtccagttttcttccctgatacaatctgaaagtttttgtccccatgaaagacttacatattgaaattccaggccccaagttgatggtatggagaggtagaacctttggggagtggggccttcatgaatgagattagtgcccgtataacagaggccctagagcaatcctttgcccattccaccatgttaggacacagctagatggtgccatttatgaatcaggatatgagccctcaccaaacaccacatcttatcttggacttttcagcctccagaattgtgagaagtaaatctctgttgtttaataagcaccccaatttatggtattttgctattgctatctgaacagactaagaaactaaatattactacctcttttggtggtagtaatattttttgccttcagcataatagaaactatagaatggaactcaagatacaatagtctttatgatcttaacagtagtagttataatagaaagaacagtggacttggaggcaagacctaggttcaaaacttggctctattacctattaagcctgtgagtcatttactatatcttttctcagtttttaaatctctgtaatggggacaatacttcccataaccacctgacacatatgaggtgagggtcaagtctgattcagctatggaagtgctttgttaatcataaaacctaatataactgcctgcattatttcctataatatcatgaaaaaggcttctatggagagccaaaattatgtcaatattttccaatccattccacagggcatggtaactgtcccaagagttgcttaaataaaagaaaaaaataaaaactatctagacagtcagatttttaagaaaaattatggtgctatgcttctcaacttcaattactttatgtgcaaaatgtagtaaaaggacctgccccaagattgttgtgggtgggacacacacacacacacacacacacacaccctggggccagtaacctatgcataataaatactaaattatgttcgtttctccccattacactgttgagagcctcacccactctggctcccttctagtttgagcaaaggccctggttcttattgaaggagtaccagagtgggtacctgagcccctgccacagcacctgggaaataacagctgctagttgagcaccagatgatccagagttaggaaaatccctctatgtggagtaaggcacaggaggaagaagaaatggggacattctttgttcccctcactgacctgggattaacctttagaacagaatttctcaaatacttttaaatgtaaccccatattatgagtactttttatgcagtggcccagtatatataaagagcacaacacatatgaaccagacatatgctactttctattcctttaatcctattacttttaaaaataggattttaggacacactaattggtagcagtccaacagttcaaaaatgccactgtagaaggtctcccggcatgacctccaacctcataacttttctgggcactccctaaggtgtgcccttagggacctgacaagtgacaaactgactattaattgttttgcagttcagaaaacaaagagatcataaccaggaccatgggtttagaggagctaaaaaatacagaacagaaaaaaatataacttgtttttcttagatgctttgttcatgacccccagagaaaacgtgtcacaatttctcttccctgtaaatgctaagaatcttttaataacaataaaagggtgaaatccatcttaggccccccacaccctgctcagggcaggcacttcatcatgctctgccactgtcaccataaataagatctaggtcttacaaatgtgtctgctacctgggacaagcccagagccagatcacatcttactatccagaacgtggttgacaaatgtaccagtttcccttagacacacagcatattccttgctgcagtgtaattggattttttttaaaaaactttttactagaagattccatagaagaggaacagatgagtgagcggttgggatcagcgttgagcctcataactttctcttcagtgtctgacttgcatctgttcaagtaggtctgttttattaatgcttactggcctacagctatagccataatattaaagatacaatgttagcacagcactgacacatagattgttttccataggaaagaaattaatgtttgcataggatattgaacccctggctttcctccaactttctggcctccatgttcaaaggctggattaaagatacagattacaaaggggctcctattaccattgagaatggggtagagatcaatgaaagttaaccattacgaatggggtagagatctgtgaaaattaaccattaagaatgggatagagatcaatgaaagctagactaggggtctaaggctgagataccacctcacctcaatgtgagaccagacttcctctgcattgatcaatcctcaagcatcaggtaatccatatggactagcaggtacttggtaaagaaggaaacaaagtgatcccttgactcataaaacatccaaacagctttgtcaggcaggtggcagaatttcatttgtcataaatgctggggtccttttgtcactaagaataagagaatgtagccacctcaagtttgatcgaggccaacatttatgctcaaaatattgtagggtggaacatttaaattcagtttctacatagctgccatcctgtataccaaggactctgaaaccccagcccaggaggcccttctaagcagatgagaacaatgagagtctcaaacacaagggaaggcgggggttgaatgggaaggtcacaacccagtaacctggtctgtgcttcggggcaggactccagacagatgaatagagagggccttagaaaccagaggccaggtggagggaaagctgcaccgatggagggcattcagaattgggagccaggggactggaggtgatactgctgctgactccccgagatgttcagactagatgctgctgataaaagaaaactgactcctcaggaactccctctcctgcgggaacaagttcctcttgggattggttgccatgagttctgggtcagagggagattagtctgtggctgaccagcctgattatggttttcttctggagctgggcttggcaaagttattctgcaaagagtagtaagtatttttagctttgtaggccataggctctgtcttgctatcattcaactctgcccttgtagcacaaaagcagccacagacaatacatgaacactgggtatggctgcattccaaaacaagaaaatatatatttacaaaaacaggcagtgggccagatttgccttgcagaatgtagttggctgagcacgtgtactttgggctccctaagtcctggtttcctcatttctaaaatggaataatgatacctatctctagggttgttgaaaggtttgaatgaatggatgcatgctaatcctgcagcattatgcgtggcacaataataaaaataacaatagcaatacaatccgtattgtcattattattattttcccattcctggtctaggaaaaagcattcagagatcaattctgcccactcatctcactcactgcacttaatgagctctcttctcagatccatataagatagggtatatgggtcaattatcaaattccaacctttctctgttcaaatgcataaaagccccataaccaatccctgcccactcttcctgtgctcactgagatcttgtctagctcattcttctgcaggcatcctggctgccactcaacaatggacttactaagaaaacctgagtcatagtaccccaacctggatggaaagagtatgacaggtgcccagccctgccccattttctaagtggatagcaccaaactgaagggattgctaaacagtgtgtcactagtcttggccggcatgctcttccatgcagaagagattgggcagataaccatctcttctggaggatattaagttgtgttcttggagatgagaggatgaactcagttgacctcttaggacagactttcttgtcaaaggatacttggaatctctccttcctgttaccgctggggaagggataagtagaaggtaatgaagcatgagcctcccctacaggaaggaaacacactaggcatctccaagtccagttagaactttgccatccactgtaagcaggctcaccctctgaccctgggagacaatgagatttatctatatcttgtaaccatcagtgattagaaacacatccagacaaagaagcccaagggacacttactgctccataatttaacagcttctctccggacactcctttggattatttaaattgcatttttttccaagataccgtgacctccccatctcatgaagtgtgtttaccaaccttcttctctcttctcacattcttctttctccctaaggtcaaagctaaaaatggtgacatttctaatgacacatgtctgtgttttaaaacggagttacccccatcatggataacccagcctccacatccacctcatgttgatgttgaggaaaaacaaagaacactggaaagtgtaaactgcgtctgttctggaacagaaaatacctccaagagggactgatttccacatggagtttagtagctcagcgatgccacccacaaaagcagatcctgtgtttgcttttgtgtcatgagactctggagacagaatgaagacatgcttttatgcatgcagtatgattttgtgattagggttttgttcctgggctgggcttgacaaagttcttctgcaaagagtagtaaatattttaatctttgcaagtcatagggtctgtcttgctatcattcaactctgcccttgtagcacaaaggcagccacagacaatacaatgggcatggctgcattccaaaacaaaacctttgtttacaaaaacaggcagtgggccagatttatgttgcagaatgtagttggctgacacctgttctggagaaaaatactcttttctccacaaggccatccctcctatccatcaagcttcttgttcatggcccagtgcgggtgctcctcggtacttctattttcctcctttctccttcgcttttctttctctgctcctttctttgtttctctcttctatatcttcaatctctttctgtttttcttgtaaagcacttgcccaccacattgtaatgtaatcatctgcacccagatctgtcctctactggacttccttaaggctctgtttctgagagtttgtagttttctgcaatgctttataggcagtaggtgctcgttcaatgttagctaatcagcctgctcaactgggacattttactccttttcctgaatgcctggtcttcctcccataacctccacagcagctgtgtttcaggagcagctcctcctctctgtttggagctctcagtgttggaggaacagccactgggatgggattctctgagtccaggaaccttcagcagctggtccccgcctgaagagagagctgctgttccagttcacagcacacctggttgtgacaggagaacaaaggagccctggcaggagcatgagtcagaccaagagggggcgaaagccttttggtgaaggtcccagaaggcagaagtcttttcatagggctcgggtcagaggtgttccacccaagaggatgtctggcaggtggcagcttcctttctgcactcttgccccattcatcctctctttggccctcatctcttcaagagaaggactccttcctcctgttttgcaaaatgactaattttcatttatgccaatctagttgacagacccaggtcaacgcagggctaaggtaagtgtctgacttcacaagcccctggggcagcagctcctctgatggttataaagagctgctcaggggatgttgggcctccccacatggtctttttttgggaaagaacttacctgctgagtgtgcatcttagaggcctgctgtgcttttggctccagaaatggtgtcatctggggcttggcctgagtccaggttgctcttggtctccttcagtgagacatttccccctcccactcctccttgccctcttgctagtttcacagatgcaccaacacatccatttttaatctgaccaaatcaattacaaatgttacagattgtaattaccgaaggaactcccaaaaactaattatgtaatatgcaatccccacaataaattacacctttcctttggcttgatgttccagaaaactgttttctgaggaggcagagaaagtgttgctcatctctgccagggatgctcacgaaacggctctttatttagctccgctgcatgtttgtgggtgtttgtcagaggtggccacaggcttcgtgccagggctctgggcagcagccacatcatcttttgccaccataggggatgttgccagaatacccatgggaccatgtcttcttgtcattccaccaccaagagaaacttcagtttccttgggcaaaaatctgggagttctggtaacggaaagcaaatagcagatgcaggagatgcttaaaaaggaaagagaagcaatgtgttaaccttggcctgagactagtggagtcctgttaagtgatggatcactagagcgttcctcagcaacagtgcctgtcagagaagaaatccagagccgacatttacatttttcttttcttgttttcttttcactatcatcagacaatggaatctccgagcttgctgaatctcagctttaggtaccaataaaggctttccttgacctaaatgcatttgaaaatcacactataaaattatgtcagtgataaagtaagaaattcactcatttagaggactcatagcctcagagttgcagacccttcactgggagctgccattcatgtgaaatgctattcataactcttaataaaataatcaggattaaaggggaaacagggagcaaacttgtaaacatctcaggcatggagcaggggatggagaagtttaggaacaattgcttatgtcaggagggccaaggaaggctgacagaaaagaaaacgttctttgagtctcaatagtagtgagagggttcccagtgaggagtgagcttggggtttttcctgtgtgtctatgtatgcacgggggtggtatgtgtatgtggcagtgactatgtgtgcatatacatgtgcacatgcagatgtgaattgtgtgcatgtgtgtatgcatgtgtgtggatgtgagtgggtgtggatgtgagtgtgtacatgtgtgcatttctgcatttgtatatgtgttgctgggtatgggtgtgtgtgcatatgtatgtgggtgtacatgtgtgtatatgcctctgtgtgtgtgtgcacgtgtgtgtgtgtatagggacatcaaaacacacaagataagaaccctttactcttctcctgcagccttggcctttacttccctgttacagcctccgtggttcttactgtagattcccattgaactgaccgcctcctctcctaggagggccaggggagggggcgtctgtgtgttcttcaggtgcacacccagccctgagcctgcctcctggtaagtgctagctcagtgtctgcagagcggtggaactgcaccccacactgatgggatgggggacagttagtgtgcatggcgggcagttctcatctcacctccttcctcaccagacatgctaagttccattttgcaacatggggagtctaggttttgtcacttgttttttgagcatttgtttttaagacagaaatgcaattttttgaattagcatggacccaattctggcatatagaataaagtctatagaaatctgaagaaacttttcttttttcaaaattcttgacatcggaagaaacctcgtggaatgctctcagtgtcttttactgcaaacctccacatcctcctggtgattctcacgttctcgcctctcatgtccacttggtaatctgtcattttagtttggaaatgattcaggaacctactcaatctctctttgtaaagctgcttttatgaaaacagtcattcctccttgcctgtgtcaccacaaaattgctagcttggtttctttttccatttcccttatttcattctgtacaccttgccgaggttactgtattactctgtcttgtactggtataaagaaatacctttacatggccaggggaggaggaagatggcagagggggtagtgctatttatttatttatttaagatagggtctcactgtgtcacgcaggctggagtgcagtggggtgctctcagctcactgcaacctccgcctcccgggttttaagcaattctcctgcctcagcctcccaagtagctgggattacagctgtgtgccaccacgcccgactaatttttgtatttttagtagagatggagttttgccatgtgggctaggcttacatacttttaaataaacagatctcatgagaactcactcactaggtagtaccaaaaggggatggtggtaaaccatgagaaactgtccccacgatccaatcgcctcccaccagcgcccacctccaacactggggattataactgaacatgagatttggtggggacacaaatgcaaaccatatcggttacctttcagtaagaagatctacttgcattaaatgggaaactatgaaattgcccgtatccaacctctcttgacctgcaaaaattcgcggtctaacacaggtcaccatgacacggctacctagttctcgagtctgtgttggcctctcatgacaatggttttttgagaagaacttgctgtactttgtttcctaatcacttcctcagaattaaataagtggggtggtatccaaaatctcacgtcccatcgatgtcatttgctgggtaaccaacagtgaagatcagatatttacctctgaaatgcgatgttcaaatcaaataataaaacatctctatgtacacattttatgcctctttgtaatatcaattgaattctatcctttctgaagtcactacaccatttctcccagtaaaaaattgtctgccaaatctgagttggttctgacactactaattttgagttgagtgaccttagataaatcactcacctttttaagcttcactgtttttcatataaaatttagatatattaataatagttaaccaactgggcttgtctgaaaattaaagtaaaagtgcatataaaatggtctgtagggttatttgcacctactaagttctccatggagttgagttggcattatttttctggatcaattcaaggccaactctgtttggatcagtcttgtctggaccctttctgatactctgtaactaaacgacaactcactggaggcattttctctaaatcctcctaagtctgagaggagagagaggtctttattaaaaaaactagacaggaacctaatggaaatcttttctctcttttctttttaaaaacatatttccaatgaaaatagtactagaattttcttacacttacataagtttatgtggagaaatttcaaacagatttttaaaatatgagtgattcttgccagagatgtgaattgtgaaatgaatttagaggagttgcagagttgcttggtagttagtattcttcactttactttatgagaaaatattggtattgcattaagtttttaatagcacatctaattatatcctcattaatagatgtcaaatattattatttaaaacattgcttccattaattatgttttttaaattaaacagctaattttgaacaagttatatttaaataattacatctaatgctaataaaatggagtgtgcttcagcatcttctttagaaacacaacataaaatgacctgtaaaattaagtctgattttctttccttggctaaccagctcctcagcttcaggcctccctcttcctagcttcaagtcccaccagaatccacacacagcttacacttccaacaccagcattcgctgtgcacactatggtctcccataatgcaggattttgtgtgtgtgagtcttctccctgtagtgtccattctttgcttctgaacctggagaaaatctcacgtgttcctctttagagacacctttcctgcctccccctgacagagttactgattccatctgctgagctcctagggtgcattgcctgttcctctgctagaacattcaccaaactctaccgtaattgatctccaagcccatctcgccccgactccactcctaggctcttttctattcctgtgcccagtaatatccctagcacatggtaggtaggtggaagaaaggttgcttttctttccttcttccattttttttctaaattaatgaatagataaataaaatttgtagactaatgatatatgtttgttgaatgaatggataaattaaatgaattagtgactgtaagaattttagtgcatttaggatttatatggcctaggcacactgggtaacaaatcagaaccagaatatgtatacagtagtccctcctttccatgagggataagttctacgaccccccagtggatgcctgaaactgcagatagtactgaactctatatatactatgcactaattgtttttcttctgagacccatggatagaatattcatccttaccatagatcttagaaacttcagcatatcttttctttcctcattaagttgagaactttcaccttttgaccttactactactcttggcacatcagaatcaccagcaacactattattgcactttggggccattattaagtccaacaaaggttacttgaacataagtacttcaacataatgacaatggatctggtaaccaggatggctgagtgactaatgggcagaatgggcaggtagtatacacagggtgggttccctggacaaagggaggattcatgttcaggccaggatggagtgggacgacacaagatctcatcacgctacacagacctgtgcactatttaaaacttacgatttgtttattcctggaattttccattcattgtttttggaccgaggttgacctcatgtaactgaaaccctggaaagtgaaactgtagataaaaggagactactgcattttaaaataaaaaagttaaaaacaaactataggctgggtgcagtggctcacggctataataccagcctttgggaggccgaggcaggcagatcacttcagttcaggagttggagaccagcctggacaacatggtgaaacccttcctctaccaaaaataccaaaatcagccagatctggtggtgtgcacctgtaatcccagctactctggaggctgacgtgggagaaccgcttgaacctgggaagcagaggctggagtgagctgagattgcaccactgcactccagcctgggtgatagagccagaccttgtgtcaaaaacaaacaaactataaagcaatgccattgagtaaaatgaggtaatttatttaaagtgtctcacaaaatgcctctcagcgagctctcggatacggaagatgtgctttactgtgcattgtgcttcttctcatggttgctgtgttgttcagtaattagtaaataaaaaagaactacctaatagaacatatgctaccagatgatgctgaaacatctattttacaatgctatttttatttacatttaaaaagcttttgaaataaattataatatataacctagtttaattatatataatgtgtaaaataactttacatacatatactgttctttgttatgattcttataatacaatatcatggttttgttaagtatattaattcactcctttcttataccaagttgctgtaacatattatgcattatcttaaattattttataatattgtatgtggcatatagtaatgaaattactatagaactgaatgtgggataaattcaaatttgtttatcagattggggtaacctccctctgaaggtactgacagctttcgctcacacatcttgtgaaaagacaaggtttttcagcagctgacttgaacaatatgggagtccattctaaatacttcacaactattaaaataccatacgttgattatttacctacttaaaagtaaaaaagagtgacactctctatatcatgttatatttaataaacataaatgcttcattcttatttcacttacacagtgatttctcccaatgatgtttatagtactagcatctatggccatgctacctgactgtaatataatttcattgtcaggaaaaatgtatgtgaaaaaagcaataagatatagataactgtaaatgtgttacttctaactaaaatagaataagacatccacaaaattatggttttactccagagtcaatggtaggtggtagcataacttactccatgctctgagcccaagagccatctggttttcttcctacaactgagactgaaattcattgctctgtaaacttcgaatccctgggtgtttcagaaagcaagcagatttgattttgctcttacaacaaaaaggcctgtgtaaagaattcttttagtctgtaacaatagcaacactaaatccttttatctgaaacctaaaggcctgatagaaacatagaatttgggaaacagttccaagataacaaaatagagtctttaaatagcattgctgattttttggtttttttcatatagcctcttaaacatccaccccatcctgcaagttttggacttctatccatctgtactttctttatcgaaactgtaaacatcctgttctcatacttcatatgaagtaagaagcaaaataaaacacaaagatagaacagacagtaaaatagcatacaaatgtttgtagtttatattagtatatttgcctatggcaagtgtactaaaatcatctataaaattgccaattaacttgaagttatagcaagttattttgggaagaaatggcccacgttagcactatcacttttgcagtttaacagtttaaggtatgaattctcttaaacactcctgccccttccatttctgtgtatggtgtaatgaaagcagcagagatatttggttatccctaatctggaagtggagtgtatatttctcaagtttaaagaagagaattattctgcctttctttaattagcatttgttttgggcatattctatatataagacaaaggataagaaccataaggattatgaattaatagaaatgtgtctctggcttctaagggaccatacggtgaataaatgcattaaaatcaaatgggtaattatttctaatctgcatgatcatggatgtttttatggaggaggtaacattgggtttattttaagctgtggtagagttttcaattagccgtggcaagaaggatggcattccagctagagtcagcttggacccagtcggagaacagcaaggccccaaccgtatttgaggagaggtgagagatcaagttaattctaatgaagggattaggtaggaccatgtagttgaaaactcagacgaagaaataagtaaagacgaggttttggaagctcctttctctcgccaagtgtgtaataccaagtctccaaaacagaagatgacacagatcaaagctctattaacttaaggggcagagaatgcccaaggttagtggaatgctcacagagttcccacagtgagaaggttttgctcataatatgtgtctaagatattaacactcagtaaattccaattagactgtttatgtaaggattctgattcataaacataatttattaaaacaaatagaaataataaggtacatatatgtaaaggtatatgtgtaaagatatatatgtctatcattctgccatctatcctctgtcattccatctatgcatatatctatttatgtatgtatctatctacctacctatctatcatttatctatcaaatcgatctatcttggctgttacttttaaactcttcctattatagacctcaattctaaggataagcatctctttcattaacactcacctgcctaactgctcacatccacctgcctgaactcagacttcactgagctcaacagggcttttgcgcagtttatacctgcacctctagtattgtttaagcatctctctcaagccatattctgctatgctttcattttaagcttttagttcctagcatgtacaggcattatgagttgagtgaggaggaagtgtttgtgaaaatagaaataccatttgaataaaagctacacaagtccttaaaacatagtccctatagagatgagtttctgacattgaactttacaattgtcatttcacttttaattccctgacattgttccatgcacctcaccaagattcttttagccgcagatcatacaattaggaatatgcacctcacagaaggcagtgttataatgtcaaaggacttcgacaattctccaattgaattagtataaatagagaaaaagaaagaaagaaagaaagaaaacatataccccctctggatccttggataagggggtcactacacagaggtatagattcataatgatgtgtataagccccaggaagctttaatttgccttccatttactctaaaccctctggaaaagaatgagaaaaatataacaatgaagaagaggttagagttacaatctctcaccactccggctgcctctacatgccaaagatgagaaaaaggaggtgcatcttgcgggagcatcaaggcttgggaagctggattcttttcgtttgggcccacagagatcaaaaacttcagtccctgggaccagcagggaaacgagaactacatggaccaagaccagtcctgttgccttagtctgaggcaacctcagcaccattcattctaacaagcccggtgatgggtctgattgtatcagaagtgacctggccagcaccactcaccttagggctacctcatagaaagagattaggctgtccagtggaaactaaatattcagaagactggagctctcttcaaaagaaaaaaaaaaaaagaatgcaccaatccacataaactgtagagctacagatgaatcatatacctttattttaaaggtaatattgatgctgaaattcacactgtcgattctttgcgaggtttgttagctagaattatatctaagatgtatgtgtgtcaataatttgaggagaaaatggtaaccaacgaagatctaggtataaaatgaagttttctgaggatgagagggagtggggtggtcctaaagctcagcgtgaggggatttctcagagatctcattggggatatacattgaccttggacattttccatctgttgccttacccttcatttccttaaatgtgcttatggcctcaagctgctttaaaacatagcattcatgtctatgtacctctagcattattatttgcacgtctttcatgagccattatgagtcaaaactgttaatcagaacataaaataatgtcagaaagagaaagctgcagaggagttaaaaatgagcacttttggaaatgagcaaagcgctgaatggcatgctacattcattggctggagcaatagatggcgttaatttctgggacaagactaacaatatataagcacttagtaagagttatataacaagtaaagactggcactaaaggagacatctataaatttaggtcagaaaataaatgcatattatcttttaacttttcaaaggattaaatcctatgtttacttttacaacgtttataatttgttttccgttcactgaaaagtcattcctgacctttcccatgccatagtttatccttatgtggcttagttgacatccagtaacccattttatctctgttgttttgaagcatataagatagaaaagaccttctaatagaaaattagggtggcgataccgcttactatagaaagtttgaccaaaaattaaactgaaatctaagtgctttcggcaaatctatatttctttccagatgctctgatcttcttttctggggggtgggtggggggtatttgtgttttatttttcattgactgttattttaagttctcaagtacatgtgtaggatgtgcaggtttcttacacaggtgaacatgtgctatggtggtttgctgcacagatcgacctatcacctaggtattaagcccaacatccattagctattcttcctgatgctctcccttcccccacctggcccccaacggcaggccccagtgtgtgttattcccctccatgtgtccatgtgttctcattgttcagctcccacttataagtgagaacatgtggtgtttggttttctgttcctgtattagtttgctgaggataacgacttccagctccatccatgtccctgcaaaggacatgatctcattccttttatggctgcatagtattacatggtgtacgtgtaccacattttcttaattccgtctatcattgatgggcatgtaggttgattgcatgactttgctattgcgaatagtgctgcaatgaacatacatatgcatgtatctttgtaatagaatgatttatattcctttgggtatataccctgtaatgggattgctgggtcaaatgatattgctgcctctagatctttgaggaatcacccacactgtcttccacaatggttgaactaatttgtagtcccaccaacagtgtaaaagtgttcctttttctctgcagtcttgccagcatctgttgttactggactttttaatagtcaccattctgattggcttgagatagtatcacactgtggttttgatttgtatttctctaatgatcagtgatgttgagctttttttgcacatgtttgttggctgcatgaatgtcttcttttgagaagtgtctgttcatatcctttgcccactttttaatgttttttttcttgtaaaattgtttaagttccttgtagactctgtgtattagacatttgtcagatggatagattgcaaaaattgtctcccattctgtaggttgttttttcactctgattgataattgtttcttttgccatgcagaagctcattagtttaattagactccatttgtcaacttttgcttttgttgcagttgtttttggtgtttttcttataaaatctttgcctgtgcctgtgtcctgaatggtactgcctatattttcttctagggtttttatagttttgggatttacatttaagtctttagcccatcttaatttctgtgtaaggtataaggaagaggtccagtttcaattttctgcacatggctagccagtttttccagaaccattgattaaatagggaattctttccctattgcttatttttgtcaagtttgttgaagatcagatggttgtaggtgtgtggtcttgtttctgagttctttattctattccattggtctatgtgtctgttttggtaccagtaccatgctgttgtggttactgtagccttgtagtatagtttgaagtcaggtagcataatgcctccacctttgttctttttgcttaggattatctttgctatgcaggctcttttttagtttcatatgaattttaaaatagtttttcctaattctgtgaagatgtgaagaatgtcagtggtagtttaatggaaatagcattgaatctataaattattttggacagtatggccattttcactatattaattcttcctatccatgaacatgaaatgttttttcatttgtttgtgtcctttctgatttccttgagcagtagttgaagaagtccttcacttccactgttagctgtattcctaggtattttattctttttgtagtaattgtgaatgggagttcgttcatgatttggttctctgcttgcctgttgttggtgtataggaatgctagcaatttttgtacgttgatgttgtatcctgagactttgctgaaatttcttatcagcttaagaagcttttgggctggatgctttgatttcttttcagacaatgagaaaatgttcctctgtaagttttagaatgacattgatgagttttacagcagtgtagttgagtgagatggtcccatctccctgtaaagtgttttccttgattcattagatctgacattgcaccatgtgtcccactgcttgagggaatgtattataccaaatggtaaaatatcttagccatacctgattacactgtctcattttagcaatgacccacagatatccagtagaatgtgtctgacaccattcaacaagaaataatgaggaaaaaaaaaaaaacaagcaagggagtgggtatcttttgaatgctgaaacaatagtagcttgagcaacagcaccatcattcattggtaaagtgaaaaactgggttgcccacaagcaccttctctactcaagtgacatgggtcattatgaccttgattttgatacctatacgaatttgttaacttctcctggtcccttagctacacattacagccaaccatgcacaccaaagcccagctgtattttaacactgaataagtttctaaacagaaggaatgagcaaatgaatgtggtttggttcagtggagtttcatcaactaattaggtaaatagtttgaattacatgtctgaaacatcaatgggccactcagtactcagaggtcctctcatgtaaatgctaaacttttagctattgaccatactctcagtgaaccagcctcttatatatcttttcctttagaccacttaggtcaacccattttttcataagttatgagaacttaagagaaaagcacttgctgatgaattgattcagcaagtttgactaaacaggtcaaacaccgtctctcctttccctctcttttgctttcattcttttcctcattaacccactctctcccacttccttcctgttttattctacattcccattttcataaagagtttggactgcatctccccacactatgtagggtacacttgttcaataagaaataggacatttatttccattactttttatgtgggaatgactggatttttttctagagctctagatcatgtaacagagttcatgacttcgattggggctgaatgaatacctcattccagttcttcctcaggcagagtagaccttatctataaatatttgttgattgaatcaagggatataggaacccttggtcttatctaattatcacacattttctatgccatgtgcagctttaagatattgggaaaattatctaaacttctaaatctctttttccaattgttaagtaggattgataagatctaccccatagatttgtttatttgcttatattttaagagagaacaatggccaagcacctggcacacagtaggtgattggcaatgtttattcttattcttttctcaacagtgcctagtgctcttctctatacatagaaaatgctccattactggagttaagaaaaaaaaaccggagagtaataaattatgtccttcctcttaaatgtgttaactcagggacacactttgtgatggtgtgaagtacctgacaaacacaaaaccctagggaaccatgctaactgtcccgggtgatgatggtgagacattcatggtgagcatactcagtgtgtctgtaagtgtggatgagttgtgtaataggctgctcgtgcctcttagatggagcacagcgttcacacagctctgctcctggagaaaatagatagaaggtcaagggagaatagcagggtgtgggcaatgctgctaaatactgcctcggggactcactcacccagggaattcagagttgctcttttctcgcctgcaaaaactgagatgcagccagagttgcgtttcattagaaggagacattcggtggagctcagctttttcaggagggagatgggtgacaggtagctgggagagtatgctggatgaatctgagtgtctggaattttaagtgttcgcctcttgcttctcagtaggtggctgcctcttgaggtctggcattcacccaagtcttgagcattacctcagcatttaaagagaaaacaagtgataaaaagaatccgcaaaactgcgtttaaatcaccatcaacattaaggaatgccacaggctgggttttgttcaccctgttagcatgcagaattatttttcactataggaagctgtcttttcccaaccaagaaaacaaacaaaacaaaaaaagcagaactaattaagatcgtcatatctcaataaatatgcaaatgaaaaatcaaaacaaagaaactctatcacatcataaagttgcaaattgctgtataggctggcttggaagaatggcaagggatagagtcttcttaatggctttgcttagagattgtctgaaagctgcatttatataggtttatgtttgaggatgaggatggtgaacttgccaggagaaaattattttcatactttgtctccaaactctgtggaaaggaaaggggaataaaaattcagtcgagtgactatgtgtgaggttctatgctatggcatttgtttctaagtgcatcatttcaagaagaagaggttttatgctatggcattcatttctatgtatatcatttcaagaagaaaaacaataagattcccattttacacatgaagacaacaaagctcagagaaggcaaattcctgtttctcacttggtatttggagaagaattcaaacccacaattacttatctgactctaattttatgttttgtttctgatttatattttgcccctacaccatgactctccaataccgcctaaagtgacttcacttttgaatgtgtgtttacaggacatcaaagcttcctagtgaaaggaggaaataaaatcaattttcaggtgttttctccatgtatttcccacatctcaatattaaggcccactctatcagtggaactaccgtttgatttctgcatgatgctataatgctattttctttcatttatatttaacttcagttgcaaatggtgagtatgaattgaattcatcaggtttgaaaaatcaagagggaggagagagagagaatagctaacaccctactattgctgaagttattgtaaccatgccttaacatatgtatttcatcctgagggagctgaatctgagctgcagagagagcaactctgcatgacgttggagctttattttagaagctgctgtctgctctctggcatgtagaatgctgcccttagaagaaggttctcctggacacgggctgtgttgctcttctggaccgctaggctaacttaagtgtgaggctgtttatgagaatggggaattatctggaatgagcaaacagttaataagattggaggtgatttggtatctattaagtattccacactgccctgggcacaaaggcagtacaaggagcagtggtgaaaccagtaggaggccaccacacacagaattgcttcttaccactgccagtcatattaaacaaaatagaagtatctagtcaaagagagtggtccaacaaagtgctcaaacaagttaaagaagggagaggctgatgttctcaaggaagatttcaaagagctgaatgcaagctttaccttcaagatagaaaggttggcaggagtgtcaaggcagttttattgcattttgctagatctgaacaactttgttcaaagggaataagataatggattaagtggtggcaggacacagtgactctgaccacttgccagggacatctaacaacagtgtttcatcttttcatatccatccccttttgttccttctttcttttatcttccctccttccctttcttttatcttccctccttccctttcttttttccttcctttcttccttctactttcttctctttctctttttactcttttcttctttctctttcccccctcttttcttttcccagccttacttttttgtttttagatgtaaaacattatattctttttttctcattaaaatactcattttaagccttgagaaaaatatagaaaatattgatacataaaaaataacctgtaccttatgtcatcttattctcattgtctaagtataaccactgtcagcctacaagagtagactttccagttctttatctgacatgtttagtttttttttttttaattatttttgcatttgcgtgtatttcttgagctccgttttcttcttactaagctatatactatagtagttctttttagcagtggtttctccatgggaagatgtatttactcatgcaaaagaaataaagggattttttgagtatagaattgcagtttggggttcattttccctcagcattgacaagacataattaatttcttttttctgcctcgctttaacatttttatttatttgtttgtttttgcttttgcaaattaagctttaaatttagaataattttatatttatagaaacactgcaaagataccacagaaagttcctttcacctagtttcccttatttaatttgtttttatggaaaatttattgttgatctaaatgtcccttatttaaagataatctgtctttatttctcaagttttctaagatttgccctgctttattgatgtttattatgatgtatttacttatgaacttcatatatttcctatttttttctggtttctagagtatttcttgaagatgatcatctttcaactggtatctttttaaatattatctcttacccatttaccctaaacacgacttttaaaaattccttcttgtttcttatctttgctgaactgtgtctgtgacatttaaccattctattaagctttttgttaaaatgttttttcatttagagaaaaggctgtttaatatttaaatctaccttttttcccaaaaaaatctttttctttcattatgtttcgagaacttattctaatttattaattatttcaaatataaccattctatagtcttttccaaatgggtcataatatttcaagttcgtgagtgtctgcttttgctgcttttcgtatctgctgagtcttgttcaaggtggattatttcctcatttgacttatgatttgttattttgagtgtatcttctgcaggctgtagtcttcaccccctctcaggagagttccatataccctgggtttaaaaaaaaaaaaatacctgcatggtaattttgtatttgtttctgatgggggcctcaagttttcaccaacaagaattacatggtttgtgattcacaatgtaattgtgaactctacatctgtgtaatctatgatttctatattttgtcaacattttcccccttctggtagttaggttttctaactttgttgcgttgctaacattactttcccatatttaaatctctattttttgtttcttttttaaaattagcatattgtctattgacttctgctgtaaaagataaattattccaatatgcattttctttctcatgcatatgttcttatttttattagttatagcatcacctttccattgacaagattgatagcatttatattctcttttgtaaacatcatttccagattatccttagttatatgtttattataacatagttctgtgctcatcaacacttctctgaccatgcactccccatttgtgagatcttcactatatcaatctttggatttcctagactttctcaagtagtgtctccctctacccactacatgcacattcctaaggaaagcaaatagcttttatatttcttgaggtcttgcatgttagacagtgtctttcttttgcaaaacaatttggctttttagaaaattatttagccagattttaattttcttttggccttttctgtcattagggacactgactccacagtagagaacattaaaatcagtctatgtttctcactttagaagacttatttttctacttacatgcttatatacttttttcctttatctttgaatttgaaactgctatagtgccttacatgtttctcagctccaagcaccctctttgacatagagacagtattcagtgttgcaggattgaatggatgattgaataagtaagattatatgttgctgtggatcattcagtctattcttatttctagtgtatatgatgcaccattttgagctacaagtaagtttttctgtatatgagatttttttctattatatctttaaactatatattttcccattacattgatcctttattgttttactttcacatctattatcttctctcctattaacttctttcttatatatttgaattgtaactttctcccctacattggtttttcaatgtttctttcatatttattacatttttcttattccttggatatgttcagtatgttttatgtaaacttcacaactctgattttcttgtcactgattttccccccagtggtttccaccctaattcttgttgcttcaaatgtgattatggtttccataaattttaatcacctttttttttcttgaactatgataatttactcctttcatcttttatctttttttttttttttttttttttgagacagggaatcactctgtcacccaggctgaagcgcagtggcacaaactcagctcactgcagtttcgacctcctgggctcaggtgatcctcccacctcagcctcctgagtatctagctgaactacaggcacgtgccaccatgactagctaatttttgtattttttgtacatgtggggttttgccttattgcccaggctggtcttgaactcctaggcccaagtgatctgcccacccacacctaccgagtgctgggactacaggcatgagccactgcacctggccctgaataaaatatttgataaataaattattaaatgaatgaagaaagatgcacaaaatagcaggaaaaaacttctccagagttttattaaagcaccagaataaatacacatttttgggaaatttagtattttattcttcaactctgatctgctgtctaaaaagtagcttgactgtgtttggtgtctttgtcatgaaatcttttctgattcctgtgtccaggatggtattattgcctaggttgtcttccagagtttttacagttttgagttttacatttaaggttttaatctatcttgagttaatttttgtatatagtgtaaagaaggggtccagcttcaatctgctgcatatgactagccagttatctcagcacaatttattgaataggtagtctttttcccattgcttgtttttgcccactttgtcaaagatcctagatgaaggtcttagatgaaacaaaataaaaaatggacaactgggatctaattaaacttaacagcttctgcagagcaaaagaaactatcaacacagtaaacagaaaatctacagaatgagagaaaatatttgcaaactatatatttgacaatagtctaatatccagcatctataaggaacttaaagaggaaaacaaacaaccctattaaaaatgggcaaaggacgtgaacagatacttttcaaaagaagacaaataggtggcaagtaagaatatgaaaaaaaaagctcaacatcactgatcattgaagaaatgcaaatcaaaatgacaatgagataccatctcgcaccagacagaatgggtatcattggaaagtcaaaaaataacatttgctagcatggtggtggagaaaagtgaacacatatactgttggtgggagtgtaaattagttcaaccattgaggaaaatacagtggtgattcctcaaagagctaaaagcagaactaccattcaacccagcaattccattcctgggtatatacccagaggaatacaaatcattctaccgcaaagacacatgcacacgaatgtttattgcagcacgatacacaatagcaaagacatggattcaatttaaatgcccatcgatgatagactgggtaaagaaaatgtacatatacaccatggaatactatgcagccgtaaaaaagaatgagatcatgtcttttgtgggaacgtggatggagctgaaggccattatcctcagcaaactaaagcaagagcagaaaaccaaataccacgtgttatcacttataagtgggagctaaatgatgagaacttttaaacccaaaaaggaaacaacagacactagaatctttgagggtagaggtggggaggagggagaggagcagaaaagagaactattgggtactggcttaatagctgagtgatgaaataatttgtacaacgaacccccatgacacaagtttacctatgtaacaagccttcacaagtacccctgaacctaaaataaatgttaaaaaagtagcttgaaattctttatttcaaaatcttaaaattctttaaaatttatatttgataatacttatatatatttattgggtatatcaagtcttgatttgttcttcattttacctcacatgaagacaattcatctgaattagttgtgcatatcatggaaaaatgatcctggcctgacctcccttcagtcctagccaggcacactgtgctttggtgatacattgcagcctgatgcatattgtgatgcatattgtgagtgttaacttgattggattgaaggatgcgacatattattcctggatgtgtctgtgcgggtgttgccaaaggagattaacatttgagtcagtggactgggagaggcagacccaccctcaatctgggtgggcaccatctaatcagctgcctgaacagctagaataaagcaggcagaagaacatggaaggactagactggctgagtcttctggccttcatctttctcccgtgctggatgcttcctgcccttgaacattggactctaagttcttcaacttttggactcttgggcttacagcagtgatttgccaggagctctcgggccttcagccacagactgaaggcggcactgttgtcttccctacttttgaggttttggggactcagactggctttctggctcctcagcttgtggatggcctattgtgggacttcaccttgtgatcatgtgagtcaattctccaaataaactccccttcatatatccatctatcctattagttctgtccctttagagaaccctgactaatacacgtatgtttcttacttttcctagtttcatcccaggaatctaagattcctcagagagatttttggttgatcttatcagaatgcttagtaattttcagaaaactcctcagcctgcttgacaaatgggaaaataatttatccattcttagttctttcttttaattttccaaacttgagtatatttagcacatatttttcatagtctatagattgaggttaaggccaatttctaacttcagtgtaattgatttttttggacttttattttttgagagttcagaaaagataatcgagtatcttatatcgactatcttatatcagaatttttttttttttgcttgtgtattcttccttctataaacaatgctagaatgaacttcctggtatacaaaataaatatctctgcccaacctttttactgataagatgttgaatatctgggtgaaagattgtgtcttctttaaagcttttgatacttcttgcagattactttctggaaagactgtgctacccttcagcacttgcaaagctatcagtttacctggaccctctctaatgcaacacttaacaatcttctcacatatttagtgtcaattttatacatgaacagtgacatcccattatattagctattcttattttacttagtgtaaacctcactttttaatgttttcctcattttttaatccccatattcttcatttataagttttctcttcatacccctgatcattttccagtggtgaggattttgtttgagtccaggttataagaattctttaaatagtccagataatgaccattcgatggttttccacattgcaagacttttctggttttttatatggctttcaaatatgttgactaggttttagatttctgtttcatttctaaaagatttttttaaagagttcaattgcctttggtgtcaaatttagaaagaattccatcataagttttagaaaacattaattgtgttttcttttgatattttcataatgtattttcttaatattttcaagccatttagaattacatttttatcatggtgtgagatagggttataacttgatttcatgccaaaattgttgcaggtgctctatttgaaaaaaaccctcttatagtgtaatagtttgtatacataatggtgtcttcatttccaactttcttttctattgcactatatttttatttcttcagctttactatattttgttagaccaacttataaagagtcctaagacaaatagagcaagtaaccccacattaccctttctttaaataattttttctttgaacccaattccatgtttttgttggtgatttggtcttctagttacatttcaaacaatttcaaaaatttttaataattgaataaaatatttacttcaaaatagtttataattttctttgtatgcatttaggtgtcactttatgacccacactgaaatttggtacttttttcatgtaaacctacatagtttttattgcttttatgactaagcattttatatatgttttttctgttgtggatgaattttttttagttgttacattaaagttttagctggttaatgttcaaacagcaaaactattaatatcaatattaataataatacatttattcttgtggctgagtcgtttttcctggtatgcaggtcccacagttcattcaccattcacctatttttggacattttgatgtttccaggtttgggctattacaaatcaagctgctgtgaactatcatgtgcaggtttcagtgtggacataagtttttatatacctgggtgtaatgtccaagagtgtaattgtggcatcgttttacaaagtatgctttgagtttctaaagaaactaacaaactacattccagaacagctgtacactcataccaggaatgtattaaagatctggctcatctatctcctctccagcatttggtataatgactattttaaaattgtatttctttttataggtgggcagtgatatctcattatagtcttaatttgcatttccctcacagttagtgttgttgaacatcttaaatatttatataatatagtaaaaaacaccacacaattttataaattttaattcagctgtcaaacatcatcttaaaaacttaggaaaagaaaaatctatgtatttgctcatatttttactcttttgttgcttttttctgcctgcttgtgttaaaaatttctttttattatttatgtttagagagtttcctttaaccattcttttagggtagatctgttaccaaaaaattatcaaaaatttacttcccatgagaatgttttaagtttcccttcattctggaaggatatctttgctagttttagagtgttaggttgtcagttctttgctttcaacacttgaaaaatggtgtgccattttcttctggcctctatggtttctgatgagaactttgctgccattctaattgcttttccctatggcattgttcccctaaagtttctcccacagctttcaagattttaagtttgtctttagttgaagaagattagctatcatctgtctttgccttgatttctttggctttatctgtttgggggtttttctaagtttcttgtatctgtaggtttatgtcctttgcatagtttaggacattttcagacattatttctttggataccttcacagcctctcttcttttgggacaatggtgaaatgaagattagatcttttgttatagtcctacaggatcttaatgttctctttatttttttttaaagtctattttcacgtttttgttcagactgggttttttctatttttctactttcaggtttactgattctttcctctgccttctcctttctgctgttgagtccctctactgagtttcctttatctagcttttgatattttttcattctaaaattttcatttcatttttctttatagcttccatttctttgctgagactttttgttttttactgagttctataattctgttattggatttctcaactctccagtttccatttattcttctttattttccctacctttttttctgggatgttctatttctttcctgagacattttatttttttcatttgtttcatgtgtgtccataattacttatggcaacacttatatgctttaaaatccttgtcagataattttaacagctgtatcatcttgctgttggcatgtcttgattatcctgattcttggtatgatgagtgattttctgttgaaacttgggcattttgagtattatcctatgaggctatggatcttatttaaatcttctgtttgagctgatttctctgacaccattcacacaacagaaaaagggagcttgttactgtcaggtgttgggtggaagtctaggttccccactaggcctccaggggcacccagtgtggggaggggctccttgctactgctgggccatggtgggaattccagctccccaccaggactttgctgatccctttctggccagaagaagcagcagttcctccttactgctctccagtggtaggggacagtcttgttaccaacaattgcctgtagaggtccaggttccccacacaacctccactgatattgaaggggaggaagccacattattacccagtggggataaaagtcttggctcccgcatgagggagatgggggtctggtgagagtagaagcctaggctccctgcttttgttggtggggatgggggtgggactgctggcttttctgtggtgtttgcctggagtagaacaaacttttctttcttgataagctgcccccttcctcatcgtgtggctagaggaaacaagctcttgttggggcttttaatcatctgcacctcttggcatttccagctctcagctgttccagctccaaatctagagtatgtgaggcccaaaggaaacccagagagatcattgccaactccacctgctagtcctgaggccctgatacggtctgcctttttctctccctactccatccacgtttcagtgtcttcttatttttttagtatataatattttaatatataatattgaaggaaattaggaagaggaaaaagtaaaaatacttctccatcttttcagaagtgaaagtccttgaatatgtatcttaattccttattagaatgcttacattgcatttgggcaaataagtgagagataaaattaaatgattttgagactcctaaatttatatatatgtttataacatattatgttacataatgtattatcatatcatatataataagtattatatattctatttgtagtatctattatatttattttgttatgtataataaatgtatgttattatatataaatatattacatgtattttattatatataaatgacaaaaccatatttgttataaaacactaaaattcacagacatgataattgtggtataatccatatataaaaatattttaaaaataaattaaaaagtaattccacaaaagatgattcaaatatggttttttctatatatacccctgttatatgttcaattcagcaactctttattgcatgtctagtatgatctcattacattctaggtgttctatagtataaaataaacataaatctgacagaggcatgggccttattgacaataacactataaccatgttaatgataaaaataaattaatttgtaaagactcatatttagaaaatggaaatttcattaagagatggagttatcaaaatagtcatttcatagaaattaaagtgagctttttaaaaaagctgcatttggttgtatgttgaggggttggcagacggttttaggaaattgtgaaggcttgggaaaatattacatctggtatgtctaaatgatcacaacaagtacgacttgacaacttgatgcgcgggagaactgcaagtttgtgagtgactagagccaactgtgcaggatgcaaggcaggacattatttaagcaagactgaccttgttgtgtcccactggaccctgtaggctctgttcatcaatactcacattgcactaataggcaagggagcatcattgcaagttccacaaaagtggcataataaaaatgatgtttagagaaattattaggagtgccaatttggctggttttgcaacagttattgcagtaacccaggtgtgaagcaacaaatctacatgcatgctcttcttccacaccatgtttcaccatgttcttcagaatcaacagcacagcaatggaattaaaatgtggtgattgcctttatttcacagaatactctgctagacaatatccatgtgttttgtcatttagtattcaatgcaactattgaggtattattattgacattctattagattaagcagtttttccaaagtcccacagccaatatttaaatacaggcttttgacattgcatgacactgacacctccatacctagcatgatggaggtgaggcacaggctcccagggttctcaatgacttgagcctgtgttgcagctggggcagctcttgccttcctttactcagctactttattacccacaagtcagcctgtaaaatatgataacaatttaatgttgtgatgctgtagaaacaagtttcatatttcttccccttcctctccattcaggcaatgtcccaccagaccttcagtttagggtaccgcagcctggagagcacagaagcagctcacatcagtcagcagacaattaagacactggcctttgattcatttcccgatctaacatgtaaccatgctgctgattacccattttcattgtttatggcaaggcaggtggatgaacagctctgcctgatttatgaagtgcttgccttctataaatcacagagcagaaacccagcacgctgctaatcctaattggttaagtcctaagtagggagtgattagaaagtcttcaggaaagaaggtgccttatgcaaatgagggagacatacagctccttgggaggaaactccccctgctcacaatatgctgtaaagtttttgttaatgttcgttcctactgcccccttctatcgcttgctggtcaacccctgttgatcttccatttgttaataaactggagagagggcataagtgggaaagcacaaacactgtagaagcagaatgctgtttgcccacttactctgtcatttgttaatttcaacctggattaattttccagctactataaaccattcatcatgatgaaggagaaccgtgtaatatgactcatagtgctgtttattggagtgggaaacacgagggctttgagttctgtctacctgcattccaatcccactctttcctggaagaaaatgacatggcattctcagacactcagtgatgaccttctctgattgttcacttaaagcctaaactactttgaaaaattctaaacatgtgaggctgtgcacatcttctgattggaaatagggctaagaaatgtatactctgctggcaaaggaagaaagaagcctgcaaattgttacaactttcccccccaagcctcaaggttgaggacacaggggagtgtgcatatgacacatttaaaggagcagtgatctgaggttaaaactcaaagcaggaaacttccactctcctcttccaaccaattgaatgtgttcccttttttggctaatttctctttttcatttctctctcctcttccccatcttcctccttctacttccctttccctttgtacattttccctgtctaccttcctcttcttcctttcttctccatatttcccgggacccaatggcaggtgcagcagcagcagtggcagcgtcccttcggaactggaggatgaacctgcctgcttggaggagattgattacagtaccgacaacagctcagaccaggaagggagcttgtctgagctggaccggaggatccaggagtgtgccttcaataagtttgagggagaggaagaagaggaggcaccagggcagggaggagaagccatcccatagccccgaggttcacagcaagttctgtgtctccaaccattggattggactagcagctgtgttgctgcttcttcatcatcagacacacacaatgtatatgtcagtgcaaaaagccagcctgtgtgagctcagcaaccccatttccagattttgttctagtttccctatgcgtagaagctagccactttataacattttatattagagttaggtagcccttggggcctatgcaagctgctattgtacttagaatgggacccaatgggtagcctcaagattaccatggatcctttcaagatttttctgagttattctccattcttgtgcttgaactggagcaagctggaagtagaggagttgggcttcttcttggcttctcagccagaattctaagtggttatttaagttgttccatatacaagtgttatcttccaatgttatctccccaccatagcatttgagcaccccagaacaaaccactgagactctggggatcctggcagggtcttcaggtgctggggcttgaacatgaaaaactgtgcatccaagtaattgcaggtttcatctgtgatcttctcaagcagcatatattttacatatgtggtacaggccagaagctgcactagactcttagaaataagacattgtcactgatcttcacagattttaagatcctatgtattcagatcaccaaacataatgctaggaagtaccagacctactggaaaatttattcatttcagaatctgacagatatggttcatatgctagatctggcagttgcttgttatgacaatttaggcaagtaattaaattttcctaaacttcagttttcttatatataaaatgtggataagtatatctatatcataaaattattgtaggatgaaatgagatgatatataaaagtgtatagcttagcatttggtacacaacaacattggcttatttttcttcataacacaaaagaacattctatataagaattctgacagttaagaaaaaattctcaccagcctggacaacatgatgaaaccctgtctctactaaaccccatctctacaaaaattagccaagtgtggtggcgcacacctgtaatcccagctacttgggaggctgagaaaggagaatcgcttgaacttgggaggtggaggttgccatgagccgagattgcaccactgcattccagcccggcaacagagcaagactctgtctcaaacaacaacaacaacaacgacgacaaacccagaatccagaattctctggagtcacatggtaggaaataggccctcttactggaagggagctgggaaggagattacagaggagcagaatctaggaggctggaatcacttaaaacaggtgaaaatggagcaaggccttttagcattcggaaggaagaggcttagttatttgaataatgaagtgtacgagacctgcgaagaaaggatgagaagggacgacaaaggcagtggtagagtgagagatagaatacgctaggtcaaacttaggctgttttagatgtcatgtgtattagttaggattaggtttagctgcaagagatggacaacttatcatagtagtagctttcataaggcataagtctatttctctttcctgtggaattttacacactggaagaccagtcctagtgtcatggctgcatggtgtcagagacctggcttctgcagttttctggctctactgtgtgtgcttctactcttggtctagaatggctgctgaagcatcagtcactgcatctgcatcccaggcagtagcaagaagaacacaaaaagaaatgcctgttttctatctttccaaaagctctacataatatttcttcttaatcccaccggctgaaaaaaatgggcctatagccacaggaagctgcaagagaggttagaaaacatagtctttatttgaggtgggcccagctaaaatttgaagtttgaagtaaaagtctgaatactaagggaaaagataataatacatattgggagattacatatctgccaaaagacttctcctgatgttccaaacaccaccaagggagttttggatatatcagaataatctcagatgacactcatagcacacacctcttgaccagcagaaagccacagaacaaaacaggattagctccaaggcatagaagaaaggcatctgtgttgtgattttgggagttgataacattattaatagtctcttatttttttaactcttttccaagtttccattttgtagttcagaaattgtatatccattcttcatattaagacatgtatgtttatgtaacatatgcaagaaatttgaagactattagcaaagataatgaaagtgaaacccaaacgctatatagctcttaactcctcccatatttaatctttccactcttaaataaaggctagcataatggtgctgatttctctttgctttgaggattcaagaagataatattgaaatgtaattgctgagagaggtgggaatgatgctagcttatcattaattattatttcagcccaaattagttttgggggttagcttctggtcatgaggcatgtttcttaaaaaacgtgaccatgacagataagtttttatgtggcatgttcagaaaaagccaggaacatgaagtatttgttgatccatctatgtaacaaatgtatatttaacccctaactgtgggtcatgcactttactaagctctacggatgcagataagaaagacctattttgtgccctcagtaaccagacaaagaagaacaataaacattctaagttaatgcagtatggcccatgccattatggaactctgcaaagaatattacaaaaacgcctaatctaatgggggtggcagttgtggtaaaagtctaccaaaagaaggtcataatttgggtgattcttgaagaatatgcaggagttttcaagtataaagggagaaaagacatgcgaaggagtggaaagattttgtgcaaaggccctgtggtagagttagagcttgaaataaaatgttcagtgtgactggtttaaaagatgtgtttgtatgtgaggaaaggaggagagtgacaagagatgaaatggaaaaactagacagcagtcagataaagctgcatttggcattccttgatgaaaaggctgaatttaattctgaatgtaatgggggagacttaaagagctttcagcagaggcatgcccgtgactgatatcagcgccatttttcccttgtttatggctgagggtttggtgctcctgctatgctggttgttcagtagtttgaggagtgccccaggtgtgatactactatatttgaagagcagaacgtttgcattcaggtcaaagataataagtgcagtttggggacatgttaaatgttggtggcctacatgatagcccgttcgaaaggtttcctagaaatcagaggtacctcaggaagcagaaggagaacaaagagaggtgtacctaacacttggtgattttggggacacaggtgaatgtcctgagcacctaagcccaggtgtcagtgagttgggaaggcaattgattggagggaagaggggacttgggagcagacctctctcctttcctgctaggactgaaggctatcttgtgtcaaatctcaccagtcttccatccagagttagagggtacttacttgagagttaactctcaatagttataagagccattcttccagtcaagccaggactttctcttgctggccagaccacttcagtgaattgttgggataaaacgtgttctaccaaattcaaagccaaactaagatgacccaagaattccaaggagttgtaggccataatgggaagcaaatgtggtccaaaatgtgcagaggagagaggagagtccagagaggcgatgttggggcaggccaagtgcatgctgtcctgtaccaactgtcatccggtgctctgcatgcaggactggaactggggctgaggggctgtgggggcctgcagcttcatgggacagcctggtaaaacttctctgatgggcaaaggttgggagctttctgatttcacctttaagatagtcccattgttagaatagaagcccaagacttgccacccacgagccctcaagggtggaaactactgaccccttcgtaacacttccctctggcaagaggctttgtggcttcacatttccttcagaaggaagtctaaatgtctcaacagatccctttatagcctggccccaatctccttgacagcctcaggttctgacattctttgttctctttgatttgccacagaacataccctctttctctctcatcgcacttatgcttgtgagtgtctacacacatatgcacatgcacagtgcaataggggcatggaagggcacttcttaagccacacagctccctaaatgtactttttgatttttctaacattttcacatttttcctctgcctctgataagaatctcccattctctcatttgggaatatcaaaactcagttcaaatatcacctttcttctataaaacttgtcctcatcacccaatgccaagttatatataatctctcttccatgcccctgttgcactgtttatatatctcttttatactatgcttatttttaacttgataaatatgtcttttatacccacacccccattcaccattgaatagtgagctctaaagtgcacaaacctgctattatcttggcatctgtccctatacctatcatacttcttaacacattgcaggtgttcaaaaatgtgtcttcccctcagcttcaaactcagacatccaatgtttcaatgaaatctcacttattttccttaaatccctccgttttccatctcaaagaagagtttgtgttatagacagggaaacacaaagaagagtttgtgttgtagtttcactaaaaggacgtgtagcacaagtgcagcctggcctctcaagctggtggttgccatggaagagttcccagtgcgaggcgagcttaacaaggggcagggtgtccttttccttacctgtgttgtgcaaatgcttagagtggtgataatggaggggtggcatctccaagggttcccaggagctgccacatttacccaggggctctgcctcctatgctccctttggtgagaactgtctgtgcagctccatggatatcatgccaacttggctgcctgggctctccttgcaatcccatcaataagaatcagcatccaagaattccatacattggcttcagtttccttccagaaagaggattcagagccaccaagaatatttgaaattaacctgctccctgagttacaagctcaccttgagggctgccaacacaaggaaggtcatattacaccctttcatttatcagcctggaaaatggtgccgtagagtcgatttcatatgctaagggcagcctctgccctatgccaagagaaggagctcccaggaaatgcctgacataagtcatccttgttagggccacagaagaatgactcgcatggtggatctcagcatttggatttgcattaaaatgatggatttgttttgccttgctggtacagctcaccccagctccccaaactctctagtcttggaaagacatgcatagtagcctggtgcccaccaggagggcttttctgggcaaaaataattcatcagctctggagcctgctgctgtcttcccaacagatgtcctcttttgtttgtgttgcagtttggttcatgctaccaatgcttgataaaaagtgttctttagaaaagaaaaaatagagtggtaaaagggaattttgagataaaaatggattctattacaacctttcagtgcctaataataaaaagatacaattgcatataacttaaaatcatctattacacacacacaattcaacataatggagctgaagctgagtttgagttccccaccacacacacacatacacacacacacacacacacacacacacggcacagggctttaagcataacaatgagtgagggaaggttgatcctcagacacatgacacatgttcatacaggtgaggggcagctggttgatgattttaggctctactgtcacacagatgtcaagatgaaggccttttgggcagaagacgggactcatctctcattagcatgtgacataaactgtacttgaagtgtgtatatattctgggccagttccaatgcaaagtaaaatgggttcagtatcattggtagagaacacagtctatgagagaattaccaaatgagccacatttagttcttatgacaagtagttaaacagaggagagcactgactgtttacaaggctgaagcaggcaaggcgtggtggctcacaactgtaatcccagaattatgggaggccaagctgggaggatcccttgagcccaggagtttgagaccagcctgggcaacatagttagaccctgaatctacaaaaaataaagaaaaaaaatagccaggcgtgatggtgcatgcctgtagtcccagctactagggaggctgaggcaggaggatcacctgagcctggaagtggaaggttgaggctacggtgagtcgtgatcgcacaactgcactcctgcctaggtggcagagtgagaccctgtactctgtctaaaagtaaataaaaaggctgaagcaaagatgattctacatggggggatttcaatgatcttttatagtctctaggctcttatggggttaaaatgatttcttggtatcagacaagtattatgaccagctcctggcaaaataagtaacacttaagcataattatttggagctattcagttaaagtgtctgagtgtagccctggtcttgaagggcagggcaagacatggcattgagttcaattgtctctactggctgtgggacgggacaggaagcagagaagccgacaggtctgccatccaaacatccagggtatgggggttaaatgaatgaatgtcctggggtagaagactatcaaccagaccccacccacacttcattctgaagaggaagttattttgggaggtattagaggaggaaaaatctgcctgtgtttctgctctgctcagacaatcacataagtgactcatttcactctcagtaccagctctgtgggataaatggacattatgattgccattttaaaaatgaagtgcacccatacttaaagagacacgtttagtaaatgatagagctggaatctgttcccggggaaatctgacttcctaactcatgctccctccacttccccagaggaggtgaatatgaaccataacacagttacagctaacgtggtaattagcaacacttagtatctataatagtctaagaccatcgcaggtgtcatcatgtttaagcctaaaacttcagcccaacgagctaaactctgttgttatgctcactttataaatgagggcattaagaatttaagggctagcctaagatgatacaggtagtaagtagcagatcacaaccttaactcaggcaatcggactcttaaacttgctctccaaggaaaaacatctttcttcaaagacccctaagggccctctgagaggttatggagcaagtctccatttctaggaaagtgtgttgttcttgtagatccttgactcaaatacaagtaactcctactggccatttctgcataacttcctgctccttttcaaactcaacaggttcaaagtcaaaatctcctcccaacaaaatctctacctccaaattcctaaacttgattatgccgatagtaaaccggcgttgtttgatttatttgtgtgccagatgcagagctcactgtctggccgaggcaggtactcagatcttcactaaatagatgaatctgcaatgttgttgagtgtgaatcttagctttggttggagtccaaagctaagaatcagactcggtaacactgttctcacctggacttcaagttttcttaccactcttctcacctttggttgtgcttcctttccaaccctttcatccctgtgcagcctgatagtattaggaaggaaaaccggcttctactttcgcagtttataatttgtcagtgacctcccatggtcttaaggataaaatgcagacaggacctagtgcttgagccttttcagatccagccactacgtaattttctggtctcttctcttgacatcagcccctgttaaagtcataaaaacttactttcaattctcagaaagcaccttactcttctgttccctcttcttccatccatgtgcctagatctatccattatgtgcttaaatgtaggctcctccaagaagtctcccatgatctgattctgagttcctactgtcatcttggagaaacccagtcacagcttttgttgtatggcattgcctgtggactttgctgtcccctcttcacctcccccccaccgccccactgcaccaagactgtaatatcttggagaacaaagacaattttgttcactgctacatcctgagagcctagcatcgtgcccaagatgtggtgggacttccataaatatgtgttgaatggttgagatcttaatttctgttagaacggtctcctgagaatgacctcctacccgttgcctcagtaacctcttacgcatggagagcagagctgcaggaaagcaggacacacgtgagtccagccaactcagagcttcaaggaggcgtccaggagaaacctccctcagccccgtttgcggtgcctcctggtcggtaattttccagaagcaatttcttgtttcctccaaatggcctgtagaggtcagaaaagggccttgttttccaatcaccgactgtcctgtctacattagcattcaccccgggtgtctataattaagcaagcctaagctgggcacataggaacggaaatgcattgactttaataaaacagagtgtaaaacaactttagattgactccagccttgtttattcttgcacacttgtaattctggtttggtatattcccagtcaaagagaccattgtcctgggaactgaagcgtgtcccttgcttcattgctgctgcagcctgtccaaggaggcaagccgcaccaggttgctgctaccagctcacagcaatttttttttaaattttttaaagaagaaaaaataacagagaataacctgtgagaacgatgaaaggagttcctattgatgtcctggactttgtgtgtgtgtgtttgtgtgtgtgtgtgtgaatgtaagtacatccagagtccagaaaaaatatgtaaataataaaaatggatcaggcactctggtcttcacctattgtgtaatttaggaaatgatggttttgttctttaagtgattccgtagcatatggaatagaacattataacagaagttgagagtccaaggtttaggctctggctcggttacttcaatatatggctttgggctgaccctttcctctgggtctcagtttctccattggagggtgaagggctggaccacacgaaatctaacctcacttctatttctaatattcatgaacatgaatgctgtgctggcggggcctgcagagaacaccagcaggcccggggctggccaggccggtgaagaggcagcgtgaggtggctcacactagcgttctgtctctgcagggaccgaggccaggcctgcacaatgatctattcagagcacagagcagagcagtgccgttgatatcctgccaatgcccagcagaataaaagcttccgaaatcagggctaaaaataaataataaaacaaaatgacaacataaacaggaagacctaaaggagggggaatgaattgagtcagcaaacttcagctggggtggggcagggaagaatctaatttgttttcatccacatggtttggcctgctaggtgctgcactggtgtttaaagtgctgttggaagggggagtttgatgccaccctgggagaagatagagaagatgggggagaggcgtggctgctctctcaggctcgtttcctccccactgtgcagttggtccacccactcctcactgactctttgttggttgttcagagagagttctttcacagtccctctcctgtccctggcctctgcctgggcctgggccaactgccctcatcgaccttgtctctcagcatttggggcccagcttcctcctaggctctttgcacacactcaggatttcaatcaaaatgactttcaaatctggtcatttaggggaggatgtgtgcaagagggttagggaaagggagctcattattactgagcacactgaatgttccggccactgtacagttacatgcaacatgcaaggagacagacagcagtgacctagcagcagccacagggcaagtaaacatatgcggatcacctctacaaccttgttccaggccttgtcattgcgaagcgtagagattcaaagcagttggagacttcctttagtgaggcggtttcttgaatttggggatatgcaaatgtcggggtgagggatgaaaagctgctctgctgtgcattagatggtaccaaagattcggggagtggggccaggggtgtgcactgggagagaaggagagagagagaagagagaggatgaggacttcccagcatggctcaaggcaggggagcaaagagggcctcagagaagtcctgactcataaaaaagtgatgtccaggattgaattttaagttgttctctgttctgtgggatctcatttcactccatccctagtccctcaaatctctagtaaaagtccattactcccaagcagctgggttctcattatattttgcatagatgaaaggttcagttgttcattttggatgaaaacatgggggaagccaccaaagagaattcagcagaagcaagaaatttgcaaagttcatttctaggaaattacagattccatttatttgggcagttcatgaatatgatggtaatgataataatcaacttaccataaacatgaaccagaccttgggctgaatgtttactattcacaaaacccctttgaggtaaataactattatgatacccattttacagacaaagaaacaaagtctgggagatagttagcagcttgggcaaagtgagtggttagtggagaggctgcatttgggtttgaactgagcttgcatcctcttcccattctccccatggtgtaacacctcggaaaaggaaatgttcctagtggcagtggacatctcctcccttcatttttcccttgaggcaaacttgccttcacactttcttcttcaaattcaattagaaatggatccgtatcatgccgctgcactccagcctgggccacaaagggagacccagtctcaaaaaataaaaaaaaaaaggaaatggatctgtaattttccgagtcttattttcagacttagtcaaggcctgttttctcccccacgtacctattaatttaaattttgctcagcttccttctccacatttccagacaaaaatgctgtgtgaccttttacagaaatcttaccatgggctgatggtggtagttgatgatgtgtatgggaaatacgtgaagcacactataagcttcccctagcaaatgttcagagcaacatttttaaagatgaacaacatgaatttcaaacagtggttaagtaaacatcatagagaaatatgtccccaacaaaatcgggtctggattgggatcagcaggatttcccttaaggtgtctgctctggttcaggaaatgattcttctgggtctctgtctgtcatgtccgtgcgtgttctgaacaatatcatgtgttcccctggtgactctatttttttcagagtactactttgaaggctgtggcatagtaatgctagggataccttgcagacttacgctcagagatctataatgcaccacatcaatatcagctagtttcaagtgatactcagtttactttattaggaaaggatctatactctttaaatcctaaactgttactgttcctcaacttcacttgacttcaacctaaaaattaatgctataagtgagtggccccttcaacaagaccgcttagcaaagagcaacaggagaaacacaccttggtcctctaccttttcctgtctctgttgaaatagattttcctgtagtctgacataagtcagtgatattcccgaaagacagccttacctgagccatgcttctctttttctgaatagtttttttgttgttgttttttgttttgcttttttctcatctttagtggctacaagatgaaaagaccagaaacacatgacattaattaaggtaaggaaaaacagagcccagcaagggagaatgaattgacactgaaatctctagggctcatcaatgactagctgcttagttgcccactccctgttgagacacacacacacacacacacacacacacacacacacacacccgactacctaaggaaaaactcttatatgaatgaagaaaaaaccagagccttcaaggacactaatttggtgcctgttgcagagagcagtttttgtggtaagaggaagattataaatagaagcgactgcggcaagctctctcacgatgttttataattggtgttgtaataccttgtgccagatgatatgagaaagatggtgtggcaggatgtgtccagcctgtaaagcactcacagtgtctggagtcccagtggggctgaaatgggacaagggagaaggagtaggcaggggctgcctggcccactctgccatgggcctcaggagtaaagggcaggctcatgggggagggatatcagtacctgtacctcagttttacattgctgggaaacaaattaccaccaatttagtgctgtcgaacattatctatttactgtcttagggtgagtaagtcagaagcacagggaacctccgtgggttctctgttcaagaggcctcgaaactgaaacccaagcgtcagtcagcctggactcctatctggaagctcagggaaagaatctgcttccaagctcaaactgttgtctgaattcagttccttgtggtagtaggcactgagctccccatttcctagccagctgtcagaggggctgttctcagctcctacagtccgcctccattccttggcctgtgacatctcaaagccaacaaagtggatttaaccaccacccctccctgatgctttgaatctcttttacttctactagccagaaaaactctcttcttttaataggctagtgtgattaggttagacccaccctgatcatctattctttgccttaaaacctagtataatcacaggagtgaaatctcatcatagtcagggcctctatccatgatcaaaagtggggaaggggaaaacacagggcagatttcattgggtttatttttataattttgcttaccacaaacagtaatattatcaagggttatgtaatgctctctccaagtgctaggaacagtttaagcattttatatacattaataacatgaatcttcatgacaatcctataacataggtatattcatcccagtattctgattttacatgtgaggccaaagtattgatgtagtatacacagctagcctgggattgagttgtgatttgaactcgacaagtacagctccaggtttatgccagatttcttggctccatctaaaaatgtactctcttagacatagtttttttccttcattttgcctgagctgggatgtgaacatggtgtttccaaaacaaattagggagctgctcacctgtgcattaaggcaaaacatccactttgaggttttgcaattggagaaaggagggcattcattttcagagtgccaagcaaggagaactgggcagctcacacttagacctgacctccccagcggcttctaggtaagggtctttaaaggaagggaggcagaggttataggcaaagtcatcaataaatacgtggtggttatacattggtttgaccaaaaaagttgggacatttcgaagtaggtcgtaagaggattcaaagatttttctcatctgtgattggttaagcagacgaagctttgtttaatgatttgggggtcaacagaaaggaatggtgagttccagcctgtggatgggacttcctccaggctcctcaagaagaaatttagaacagaaaatggccgtcagagttcagtcctcagtctcctcttgtctgaggtctacgtgccagtgtatccatttggtcggggtccaagtttctgaaaaaacaactcagggacatacgttaagatgtaatttttagtttctatagggaaccaaacatctcatgactctagcttccttggctattgttttgagctactgttaccttcttgcttatcaggttgctcacttacttctcaaggccagctaggtgtctggaatttccctggaagaaactcaatattttcttttatttccatgcttggggagggagaatgaggaggaggcccctaagaggagtccctactccctcttgatgaggtttggagttgcctagtgggacaggaataggatgcagtagaaggcagcacagcatgcatggatcagactgtctgtggccaaggctgtaatgtcaaggcgcctgtggcatgtccacctcttctaatttcaccatcttgtactcagagtcttacttagttataaagagcacacgtttccccagactgtccgctctcccatatatccttcaggagcagttgatctagtaacgacatttgagatgttcaaggtataaagtgaggtcttcatgaaacagatatcccacctccatgtccctgggactctgcttcctgcacaggtctatataaaaaagggacctaacaaaccaatggttactctgtatggacttagtcgtaatttttcagtctttcattgattgggttgcattattttggcttatgtaggaggatgaagatatatccttaaaggtataactagtttataatcataaattagaagaaaaaaggctaataaatatgaaacaaagttgatttcaaaaatagtattttgcagtgccttaatattattagtaatagtattaacagagcaacttcaccaataaaattacattgttgcatatagcaaaaggcataacaaaaatcaaaatccagaaacatgttgttatttttctcagatgaagtctcgctctgtcacccaggctggagtgcaatggcacaatctcagctcactgcaacctccgcctcctgggttcaagaaattctcctctctcagcctcccaagtaggtgggattacaggcatgtgccaccatgcccagctaattctgtgtatttttagtagagacagggtttcaccctgttggccaggctggtcttgaacccctgacctcaggtgatccacctgccttggcctcccaaaatgttggaattacagggtgagccaccatgcccggcccagaaacattttaaaaaactaaacagaaggtagaaaactgacatttcataattatagctataatttaaatgctataaattataccactaaatgacacagaatatcaagtatgatcaagaaataaacataatactatttttcattcattatacataacaaaataaaaagattcataatgaaacaatccaggtggaaaagaggcaatgaagcgatttctagggagcagttaccaatgagaagaattacaagtgcaagctcaagttctgaagcaacggtttagataacgggactggtttaggaaactaggagaaatatgaatcagcttattatcacagctgtggtagaagggcatgatgaccaggaggagatgttcaatctgactgtgagagcatgtgaaaaataaggagacaaaaattgcacaatgatcccacccagggcactgcagcaagaaggagtccaggtatccggcccgagggatggtggtggcagggatgcaatcgctgaagctggatatcactaatgtggtgatgtgtctatctgcgctctcatcccttgtctctctctcttacaccagataactttgaacacatgataaataggcagagtgggtaaacagatctgttgaattatgtgggcttagggcagattaaagtgaattgaaaagactgtctccttcagttgtccatatgatgtatcagcttgacattcaaaagcctctacaatttagctcacctctgcctgccttgccgggcttgtcttcaatacacagggcccaggaccagcttttcaggcagagtggcctattccccatctcctaagtttatcctgcctgttatcacctcctcaccttttcctgctgttcctccctcccttcaaggaccaattcaaatctcagcttacccctgatctgagtatcttttgtaactcctactctctctgtgcttctatccatgaacgcttaaagcatttattatgcaattaactatatcctttcgtgcttggctatttggctgtttatctcttttgttgtggttcaatgcttcacatgtgactgtcatatctctgcaagtacactattccctgaaagcaaggttatgtcttttttatatcattcatcatttagcatcttccaatttcagtttgtttatggatattatctgacaaaatgctccctataaaacttcatgttaaatattattttcctcattatatgaactacctaattgaggattaacaaagtttaaaaacccaccctatgtcatacagctaataagtgacagaatcaagatttaaagccatgtgatttggacgaaaatcctctacttttcccatgaggccatgatatcattacaccttcctggagccattactctagataatacatcaaaataaaatattcatagcatatatacatacaaaagcagtctccataaatacgtgtcaattattttacttcatttgcccacaagttttaagttatgaagcaatctttaaatggaaagcctagataaaatgtctattcatgcatattcacagatgcacatgtatgcatgcacacatacatgtgcacacacacagggatgcatacacacatgctcatacacacaaatgtttgcatcacgatagattggctggtaagtgccacacacaagttctgcctgaaaggacattgtgatcctaatggtacaatgaatggtcttattggcaaggacatagagaatttttaatcccatttagggtagaaaggtgtgtaatcttagcagaatgctttgaggctcaattttattgcaaggatgcccagacctcattgatttggtttatagtcagcaaattactttgaagtacagccgtgttagttgtaatattagctattgaaaagctctatgtcaattcctctgttaatcatgacctggaaagtataatgaatgtggagggtgctcagcaggcatattgtttgtccaggttctcagcttattctctgtttgggagagaaagacgacagctctgaaacctataatctttcagaagtgggaagcagagagggaattgtggtggggaaggtaccacaagattgttcgtaggttcccttcataacttggacatcactttttggcagcggatagtttccatgtgcacgataagaatcattacattttgctactctgtgtctctcaaactttggccacataaaaatcacctgggtgatcaggtgcggtaactcacacctgtaatcccagcactttgggaggctgaggagggtggatcacaaagtcaggagattgagaccatcctggctaacatggtgaaaccccgtctctactaaaaatacaaaaaattaaattaaaaaatttaaaaattaaacttagctgggcatggtggtgggcacctgtagtcccagctaatcgggaggctgagaaaggagaatcgcttgaacccgggaggtggaggttgcagtgagccgagactgcaccactgcactccagcctgtgtgacagagtgagactctgtcaagaagaagaagaagaagaagaagaagaggaagaggaagaggaagaggaggaggaggaggaggaggaggaagaggaagaggaagaggaagaaaagaagaaaagaagaagaaaagaagaagaaagaagaacctgaacctgggtggcttgttaaaacagagagctaagccccaatcctggtgattgattggggaggtatatggtagagtctaataatttgcatctcttagaagttcataaatcatgctgatactgctggtccaaggaacaccctttgagaactgctgtcctaacagacatggtgtgtaattatagggcaaagaagaagcattagtttccttcaagaaaatatgatactgataatcaggaagctttttctattaataacaccagtcctaagtatttttcttctgttccaacgtcagtgctctcctttatatctcagagaatgtagagagcttctatgcattacacagatgctcatattactatctcaagccttgttcttatgtaagcaaagtagctgtccaccaaataggtgctgacaggcttcctctcattgatgggagtttttcttcttttcttcttttctttttttcttttttctttttctttttcttttctttttttttttttttattttttatttttgagacagagtctcactctgtcacccaggctggagtgcagtggcgccatctcggctcactgcaacctccacctcccaggttcaagccattctcctgtcttagcctcccaagtagctgggactacaggcgcccgccaccatgcccggctaattttctgtattcttaatagagacggggtttcactgtgttagttacgatggtctcaatctcctgaccttgtgattcacccgcctcagcctcccaaagtgctgggattataggtgcgaaaaggagagtctggatcagggaaagcaggagaacactaacctataggagaaggaaaacgtcaatatctgcttcatctcctctcctttccttccattaccttttccctccacgttcctttcatgtttctcccctattccttttgcccctgtcattttcttctctttaggtctgtaagcctctgtctatcctctcctttctatctgctgcagatgaaaagaagttattgtggaggattgccaacttccatctccatgactttacttcgtcttacattatcctcactacataaatcttttctgaacaaaatgaatgccattcgttctggtcctagaaacttattgagactttgaaccattcaggccaggcaaggtgctagccagtcacaatgactttccaatagcttagtatacctgccatgtaaacaacctccttttaagagactccatacaaataggtcattttgtttgtgttcaatgatatcatgaccttgaacacgatggatttgacccccaacccaaaagaagcaagtcaatttatagggattccttagatctatgaagtgacttggtgtgaaagctctaataggaatgccatagactggatggagacttaacaagccaattcgatttttctttgttgaagagtttgaatttgagacacatgtagaataattttacaaaagcagtgctaataatagaaatagaggtaaaaaattgccaagtcattcaagccagagtctggaggattggataccacagggcaatcaccagaatttctatgcatcatcagagcaggagttgtacttttagaactattgcattgacctcaataaaatctccactcaggccaggcgcggtagctcatgcctgtaatcccagcactttgggaggccaaggcgggtggatcccatggtcaggagttcgagactaatctggccaacatagtgtaacccgtctctactaaaaatgcaaaacattagcctggtgtggtggtgggcgcctgtaatcctagctgctcaggaggctgaggcaggagaatcgcttgaacccagaaggcagaggttgcagtgagccgagttcatgccattgcactccaccccaggcgacagtgtgagactccatcttaaaaataaataaataaataaataaataataaaataaaataaaataaaatctccactctaggaatcctgcttagtataattgtaaaatgctatttaggataaactgagtatctctgttccttatgcctcaaagtagctcaacttacaaataataaggaaagttattttaggccaggtgtggtggcttgttcctggaagcccagcactttgggaggctgaggtgggaggatcacttgaagccaggagtttgacaccagcctgggcaataaagggagaccccatctttacaaaaaaaaaaaatagccaggtgtggtggcacaggcctataagtcctagctacttgagaggctgaggcaggaggatcactggagcccaggagttccaggctgcagtgagctatgatcatactactgcactccaacctgggtgacagagcaagaccccatctttgaaataaataaataaaattatttttaaaaagttactttaggctaagatctaggcagaaggctataatgaatagaggaagtagcaataatataatccaatattgataatcatgaccagtagtagttattgaaaaaaaattaccatgtgccagcatactagaaatgtcaatcattgtgtctgcttgcctacacagacctctagggcagttgttcctctcaaaaccactgattgaaggacaaacctaggttgcaatattgtgtattacctgacctcacccttccctttaaatatttagaccaaaggtgagcagctacttcaaggacagcaaattcatagttttatatatgcatatatatatataaaatgtgtgtgtatgtatattgtgagcatgtgtgtatatatgtttgagtcttgcacttaaaatgtactttatgtaaggaatgtctgaggaaatagaaataaatgtataaaacaaaaaaggaaggataagctaggccagtcagatccctgtatgggccatttaaactaagaatatcaagataatgacttaattagctcattgaaaggttttgaaaagtcataaggcaattgatggcatgaagaacaatatgcaaactcaagtaaggatgctgagcccttgggctgtcagaatctgtgatgcagagcaaagagagggcagaggaacagaatggaccaaccagggcataggcacagagagaagcaaaggcagagaacacacagctcacggtggaagggaccagggaggacctggcctaagagaggccctgtctgcagaaagattttcaggtcccgtctgagtccaaatcaatcctgacaatgaacccgattttctttgaggctcagtgatgtaaagcccctttcctgaaactggtgagctaatatggactggagcatttatttgagtctagggctggtttgctctttccactgcactatcacgtgctgcagagcttctacaaatgtggaagaacgtatgagtcttaacaacaacgatgctctatcactcatatctatctttttctccaagtaccatgcatgttttctgtatgtgtatgaattatatccttttggtcattttgaatgtgcccctctgcctcttctatcccaatctcttctaactacaatgtttctggcaataaagcatttcatttgaatgaatgaaagtaattaagttgtctctcatattttacctgtttattttacatgtgaggttgctgaatgttaatttaagctgtgttaatttataatttttttcacattttaataatttattttttattgtggtaaaatatgcataacattgaatttaccatttaaccatttaaaatgtacaatttagtgtcatacacattgttttgcaactattatctccagaacttttttttaatcattccatactgaaactctttttttcaaactccctgtctctctgagacagagtcttggttctgtcgacaggctggagtgcagtgtttatttgtagtttcttccactgtctgccatgtcctcctcctcagtccactattcatttacattctttcctatttggttttcatttaccactattcagtctcctcaggtcaggtcttgaaacattctcttaataagaaagaatctgatgtaaatagcaatagtagtgacatctggtctggcttttttaaatggggaaagattgaaggttgagataccttttcaaggtctgccctttgtggctctgaacaaaaagactatcaacatgattatcaaggaaacagttttttaatactctttcctcaacctctggacaatacacaaaatgggatagctacgcctcacaatcccagcaactgatcacattcccctccaatatcaactcagaggcctgaatctacctgtgaattttcaccacctttgcctacatggccaggtagatgcatcttagggaatggcatccaagtaatactaatgctctggaatgaagagattcccagtctagcaagtcacaaaattatgaaagagcagtgcccagaggttcctttcagatacacaattcaacatccagttctcaaaatattaggactgcatggcactatccatcagcctggtgatcttcagaggaatccgggctttccagagagccagcgtgtttcagctttgactataactgaaaaacttccagtaatagctttctttatgatcattgacattcatcactggcatccaactgaagttctatatatcatattcacagatgaacatattcacagatgaatatgatttctaaactgggtaaactagaatatgccacttcatggaggttgcctacctgcctttcctcaattttattccaattctcatttataaatgccctttggctggctaatattttggtaagcacataggtaggtgtgtgtaaattgtctatcatgcattccaacaatccacgcttgcttgccgaaggaaacataccataaatcatggtatttgtcttcccccagatactacttaaaagggcacaaataaatgatgaatattatcgtcaatggctcactccttcccatgccacaaaatataacgaatatcactggaatgggagttaggagacctatatccttgttccagttaactgctgatagggtgacttcaggcaagtcaccaactctgaaaaaccctccagagtgaaaataaaaatcctgtcctactttccacttagggtaactatgaacaggatgaagtgatgcatgtgacaatttatttatcactactatataaatataaggggtcagcgtgaggcagggagggacaggggcgggatagcagttgccagtgataagaggaggtccattctgttgggggcactgcttcgggagatctgtttattctgtaattaacaataagcaagggagacctctgagatgcttacttagaggtcatcatttcaatttgactgctatttaataaatattttctctggttgtagatagctcccttaaaaataaacaattattttcagcatatgagcgaaagaaaatacatttatctgccatgtgctagctgttcgttataggatttaagggtccatgaaaaaaatgataaaaaagaaaatactcagaataattcaacaattattttcaaagtgagatagatcagggatccctcttaggggcctgccagcccctgaaccatagatataaaggaaaatcttgagtttcttcaaggggaattccaggcacataaaagtaaatgagcaacttggcaagcaaaaaggtaatagtggcttaaaacaatagtcaaggaagttagagttgcgagatgtctgattccctatagaaactaaagataacatcttaccataaatcccttagttgtttttcagaaacccagacccccaccaaacagatctgctggcatgtagacctcagataaggaggagctgaggactggactctgactgcctgccgtcttttactccaaatttcttcctcggaggcctggaaggagtcatcctcataagccaaagctagcatccttttctgttgaccccaagtctttagacaatgcttcctttccttaaccaattgcaaatcagaaaatctttgaatctacttatgacatgttacccttcgcttcaagatatttcgcctttataggccaaaccaaaggataacctccatgtgttgatttacaattttgcctgtaacttccgcttccctgaaatttacccctacgtttaacaacccttgtttgtaagctatcagagaggtcaggtcttcagagtgaggtacctgattctccttgcttggcgccttgcagataaacacccacctttctcctgctgcaaaacctgggtaggaatgtttggccttaccatgctgggcaagtggaccccagttcagtttggtaacaataggaatctacataaaaaaaattacattatttcactgaaaaattacagcaacaaaatgaatagtggtgcttttgctgctgctgctgctgctgctgctgctgctgctgctgctgctgctgctggttgttgtattgatcaattccatgctaacaaatctttttcatttgatacgtttctgaaattttaaggtatgtgtgtggtgtgaggtggaggggggaccttgggtagaaatactctgaattctattttcctagagttatttgcttcttaaaacaagccagtgccatcatttataactataaccctgaaggcatcatggttgcctaaatatataagcaaaatgaaatgtacaatttgcagaatctttatttgaatactttaaaattcttgaatggtttaggggaagacatgcaagcagtaaaaaaaaatcaagtgtgatgctatctagcaatgtttattaaatgcctacttgtggttctgtttgatattctgaaggacaaaatgaatgtaattgtggaatcatagagttataaagctggaagggattttaaatttatcttatctagcttgtacagtttactcacggaggaagtgaggctaaaatataattagttcctgaggtcattcaggtaggaaagacaggactcaaacccaggtttcccaagacctaacacaagactccttccaacaccctcccatttgaagagccctgttatatcaactattgctaatgtataatgtaaaattccctaagtgcatataaacaacgaagtaatttctaaacatgatattactgcaaggatagacctgaccattaactttaggctctgtcaacacatttaaaagtggagaaggggtgttcaggcattactcaagtcatttgattaatgccagcagttcagatctttcaggttctaaaatggactgctgtgtggataagctgatttgatagtgtttaggacctgtttcaaagggtgcgtggaaactctttccttcccttcttgctatgtataatagctttgcgtgggtgttgaagccagagaattgtttgaaaagagaattgctgagaataaatcaaatcaccagtcttcagagacaatcagttaggtcacatttagtcaactccgtgaagcaaggacaggggttggtcctgagtcttgtatttttttccaaaatcgctttgcaatgacatcaactatggctgactccccattctcctgcttcactgcttaccatataatggcccattatgaatgttttgctgaaggcagaaattaaccttttatggaagttttgtcccattaagtctagttacttgaatctggactgattttctttctgatgagaagacttttagccaatgttttaagtgcttgaaaaaaatgttctggtcttgactgtctgtgagagccttcctggtggaaacagaattgttagtcagctgtcatctccatggtgattttttaaggctaagtgtaagtcattcttctaaatattgaggcataatttgtgaatatgcagttgaataaataataatagaattttaaacaagatagactgcctttaattctgctgtttgagacttttcatgtgctagtctaatctataactagtcttcaaacatgaccttaacagtttctctgaaaccacctttgcaaagattatggaagtgagagaaatctaacgtggctgactccatcctgcttgtagccttacaggctggctgtccctgttcattcctgggcagaggccaagataaccatgggaggactttagtttttagtttaactttgaagcaaggatgataatagtccctccctacaactgatcccctccttgtttgggggatgaaaccaaaaggccacaaaataagggatatgggaggggtctgaattctgctcaaatgtaggcataatttctatagctcattacagctcaggagtcatgtagccagaggtcgcaagatttgtgacttccccaattgctctcatagatctcatctctattgtagaacctaagattgatcttttgagatcaactccagttatcctgtgtgtctggccttgcatcagttaaactcctttcttgactgcaataccacagtctcagggaattggatttgtctgtgcagcaggcaggaagaacctgctaggtgattacatcccctcctcaatgatcacgttttatctgcctgcctgtgttttatttcactctacccactttccgtgtatccggttccttcaaagaatagctctattctaaccactaagtcttctcttacacccatctctttgtattccccagtgtcttatgcaatgcatataacataggctcccttgccggaggaattgccactttgggaaaaacaactctagtttggatgtcaggagatcttggttgaggttctaacactgcccagtacaagctctgtggccttattaagtttctccatcttcaattcttccgtctaaaaattgaacaagttgggcaagatcatctctaatgttctccgtctgtggattctatgatgaatctcagttatagaaacaaaataataaaatcatcagagagcactggcttcctgcactatacttttaatagagtgttttttcatccattatctcttcaaatttatgctcagaggtcagaattatgataaacagctaaaagctgctgtgagctggggagaggagtaagtgaattcacctctccaaggagacttgttctgcagcttgtgagtgctgttaacccaatgttcccagtggcaaagtaggggcatcaaatgatttattccttattttatctctttaagtgtccagaaagctgttaaagcaagaaaaaggtctaacagctccctattggccaagaataagtctttgggatcatccatttagaacaatagaccagaatgtgtgaatcttcaactatattccctcatctgaaccagagagaggcagaataaacaagccagtatgttctgtgcttacagacttcctccttgctattatcttatttctccatttcaaaccttatataggttaaaaaaaaaaagtaaatagcagaacaaaactgtctcccaaagttcttggagatggctaaaataaatatttattaactgcatactatgttatatttataagttacagggtcaataggatgtcatgattaagattatagcccctggagctggttaatacagtacttcaacagtatctggctcaaagtaagcacacaataaatgttgccttttaatagtgtagttatttattattgtggttacttctgggtaccagatacatggtgaggaaaatagtaagttccctttttccatgggctgccaaaataacctctacatatattgataaatattttttaaacactgattttggggaaattgttggtaggacgataagacatactccagatattctggatccattctcctcctgatatcacaccaaattttccaaccttgtgccataataaatgggacaaatgtagcatttaagttaaaatgtaaaaactataaaataaatttacactgcagctggggtcaccttggtcttgtcctattttgtaatcctccaggctgaaccagatttcttttcattatgggagtgaaaatgaactcagcggattttctccccgattcctctccattttctgttttcagacttctccatcatgttcttgtgcctggtgagtcccgttgtcaggtcttgttgtgaccccagagatcaattagagggtcgttcagtgttttaccatttacttggcaaagaggataatgcgggcactgtgagtcaccacacggagttatggttatacatgtgacattaaaattaattgtacacgtgaatacattggtggtgctctaaggcattggatttgctcagagaaagggatggcttaggagaagacagagaaggtaagaacaaattctaggctaggaggcaagccagctaatgagtgacatttccccatgccaccatagtggtcacagctccttcaggggcaagctggggcacacagccttcttcttttatgctctttccctctctaaaaacactgggagccatatcaccctgagtggaccaacacagtctctaattggaacttatttttcagtttcccatgctctactggtggctctgtgataagagagtttatggaaacataaagagcccacgttagtgtttagccagtgtcaagtctgactaaaaatgaaatcttgttgttgtcatgctgtgggatttgcaaagagagccgcactgaggctggaaaacaggggaactcaaggtgacaattgtatgtgggttttaaagggcagctatgattagaaatgtgcctgtaaaaatggcatttcaatgttccaaatgtattcccctttggtgatttccaggtcaaattcacttagtttacaaataaaaacaaaagattcgcaactgcagctctgggagctcagtgaaagacttgaataaaggagagacttgtcctgtcctcggctgaagagccctgctccagcaggcaaggcagaggccgccactgagcagcagagcggccgaggatgggtctcacaggcgggctgctcggcaggtgcagccctggtgcccaggccctggggttctgcagtgccactaagtgcacaccatctcagccacactcgagagagcccatctttgtcaatgagtgcttttgaatggacaacaaatgcattgccaaattgtaaacagcagtgtgtatgtatgtgtgtgtgtgtgtgtgtgtgtgtgtgacagagagagaaagagagagagaacaacagataaacaagaaaaaaaacaaaagtaaattactcactgtgccaggtattgtgacaggaagtgctagtcatctatattcttgtggaaaactggccattatctggtgtatattgacacttccaaggaatccagactcaacaccaccccaggtgctatgctttgtagataggggaatgttagcaggacattcaagatacgggaatgttatcaggactattaaaatatttcttctctgacaaaaacaagtaatggggaaaagcctccctagtcaataaatggtgcttggataactggctagccatatgtagaagattgaagctggacctcttccttataccataaacaaaaatcaacacaagatgaattaaagacttaattgtaaaacccaaaactgtaaaaaatcctggaagacaacctaggcaataccatgctagacataggaacagacaaagatttcataacaaagacaccaaaagcaatcgcagtaaaagcaaaaattgacaagtgggatataattcaacttaagagcttctgcacagaaaaagaaagtattaacacggtaaacagacaacctacaaaatgggagaaaatattttccaactatgcatctgacaaaggtctcatatccagcatccttaaggaacttatataaatttatgaaaggaaacatacaaccccattaaaaagtgggcaaaggacatgaacagccacctttcaaaagaagacatacatgcagccaacaagcatatgaagaaaagctcaatatcactgatcattagagaaatgcaaatggaaaccacaatgagatatcatctcacacctctaagaatgctattatgaaaaagtctgaaagtaacagatgctagtgaggttgtggagtaacgggaacacttattcactgttagtgggagtgtaaattagttcaacaattgtggaaagcagtatggtgattcctcaaagagctaaaagcagaactaccattaaacccagcaatctcattactgcgcatatatccagaggaatataaatcattttactataaagacataagcacacaaatgttcattgcagcactagtcacaatagcaaagacatggaatcaatctaaatgctcatcagtcgtagactggataagtgtaatacatatactccatggaatactatgcagccatgaaaaggaatgaaataatgtcctttgcaggaacatggatggagctagaggccattatcctcagcaaattaaaataggaacagaaaaccaaatatcacatgttctcacttataagtgggagctaaatgatgagaacttatgcacacaaagaagaaaacaatagacactgagttctacttgaggatggaggatggaaggagggagaggagcagaaaagataactattggatactgggcttaatacctgggtgatgaaataatctgtacaacaaacccccatgacatgagtttacctatgtggcaaactttcacatgtacctccaaaactaaaataaaagttaaaacaaaagtttctttcaacctgtaaaatattacatgctatgtactaccctgttgcacagcctcagcaggctcaatccttctacagcctggacgtaaagcatgcagggacctcaaagtagaattgcaagaggtgagaccatacagctaagggaagcagagtaaggtctgatgtattaaattaaatagaagaaatggccaatacagttggttgcccatcaagtatttagtctcttattgttccttgttttgagacacactacttttttggggtgcagcaacatatccattccaaggcatgattgtgcagagacacttctgataagtgtggtccctaattttccagcttcccttgcttctgtgggaagacttgctgcccatggaagtctgctgggaagtgggtgtgaagagatgagctatgaaaatatttgctttcctgattatagaaaatagaatggcctccaagagccctttccccttttatagtcttcccatcttgcacgggacacagatatgatggcttgagtgtcagtaacctcgctgtgaccaggagaggaaggccacaaaaatggaagaaacttttgacctaatttggtagagctactaaaataatcatagtaattgcctacctccctgatcttttggagaaaaccaaagtgttgttccctaatgcctctgtcatgggattttctaattcaggcagctgaacgtatttccaactaatatggaagaatggcatgggggctgttccatctgcttggagggacactcagccattccaagcacctagtccaggatacctaacaaaattgagactaactcaagccaatatctctctctcaggggttggagaaagcaaggtatgaggttttggagcagcagccgtagttctaaggatgggtggatatcagagttgaagtaccaagaaagccttttgaggatactctgatcctctagttcagggtatgtaaaagcagattctggccccagtagaagtgaacttctcccaaaggagaagactgaatttattcaccgcctgggttttctttttactggagaactgcactaaaacaaaacaaaacaaaaaacatctgtcttccttcaggaccttgcagcatcaatcagtttcatgcaaaggagaagctccagcgttgtcttgccacaaagagccttgggggtgacccacattcactgtcacatccttcacatctttttccatctcgttgttgctttttgccacttctgaaattgttacacattttcttgtttggatccctgcatagcctgtgtgatggttaatattgagtgtcaacttgattggattgaaggtgcaaagtattgttcctgggtgtgtctgtgagggtattgccaaaggagattaacatttgagtcaatggactgggagaggtagacccactctcaatctggatgggcaccgtctaatcagctgccagctcagctagaataaagcaggcagaagaagatagaaagagcagacttgctgagtcttctgaccctcatctttctcctgtgctgcatgcttcctgcccttgaacatcagactccaagttcttcagcttttggactcttggacttacaccaatgatttcccaggggccctcaggccttccgccacaaactgaaggctgcactgttggcttccctactcttgagattttgggactcagactggcttccttgctcctcagcctgcagatagcctattgtgggacttcacctcgtgatcgtgtgggtcaacaccccttaataaactccccttcaaatatacatctatcctgttagtcctgtccctctaaagaatcctaatacagcctaataacttacctctctcctcaaaggctaacgtgatgtttccctgcagatatgccaacttatgtgagtttgggtaagcatttatcctctccatcagtaccactctttctgagcttttgctgatcacctgagtggcaaataagcagaagactggaataaggaagaaagtcagccaaatgcaccagtaattttggcagaatcttgataaccatgggagagaatagagtacgctgtttctttttttattttatatatatatgcttttttttttccagacagggtcttacactggcccaggtggaaccattattgattcaccacagccttgacctcccaggctcaagcaatcctcccacctcagcctccctagtagctggaactacaggcatgtgtcaacaaactcagctaattttggtagtccttttttttttttttttttttttttttttggtagagacggggtttctctgtgttgctcagcctgggctcgaacttctatgctcaagagctccacctgccttggcctctcaaagtgcttacagacatgagcctgtgcccggttgagtgcactgtttctaatggagccctttgatttggtatgtcttgtttgaaacacactttcttttagaaaaacttaacctcttaatttgttgatctgtaaaatggagataataataatatagacctcatagagttgctgtttcagctgagatgatttatcaaactatttagaagattgacagcacatggtaagtgtccaagaaacgtaatctctctgagtgatcaggcactcactcattgaatcacaaatactcattaagtactggttatatgctgaatacctggcatataatgttgaccactaagccatggtccctaccttcagggaacttataagagtgttgaataaaaattatagaaggaaattgttacaaactaagtgcacacacaagggcccaacagaccaaactaaaagtcaaaatggagtcacttatgctgaggctccacatcaccaaaccaaaactgagttatccaacttgagaaatctggagggagagataggcaaatttcccaaacaggccagtttcaattggcgtggtaatgaagttccctctgcctttaactcttaaacaaaaagtaacctgaagtaacttgatgttagccaatcacttttctattgttttgtttctgttttcctaccttacaagaaatataaatttgaaaggaccaatcacttcctgttctttgtttctgctttcttcagccctgctctgcctataaaaccaatgtcctctgctcagctcactggaacttattccattttatgaaatgaagtgttgcccaattctaggacctcaaataaagcaaccttagatctttaaatgtaattcttgtaactttgtcttttggcaaaagcaatcagtagataaaccatactctttggtcctatgcgtgctgtgatatgaagtaaaaaacatggttctaagtaacatggaatctacttgcaaaggagactgtgacatttacaagatgaatggatatatttgaagagcacaaactctttggcttttggttaaatattctgagactcttttcctccacatttgaaatgtattcacacttccccaggaggaaaagctaaagctcaaccctgtcaggacgttgtaatttctgggtcagtcaggagaaaaactacacagtactttaacagttatggtaatataaatattctaatagggaattggagtaatcaggaattaggtcactggaagtcgagaactctaaagaacatagaaatagtaaacatgacgaacagtcacagctatggagcagagacatcacgcccaaggaagagccctctgcagtggccattccccacccaaagctgagatccaacctggctggagaggccattttgtggctcatgatggcagagaagtcactgtatatagagataatatacgtagagaagccatcctggcagatcttgctggaaataggccctttggaatttgctggaaaactgccctccaggaaaacttcaccaggaggcatctttcttactggaggcactctacaacaaagtgctcaaagaagagctgccaggcaaggtgccagccattgagagctgctgactgccatgcaatgcagagcctgatgcaggagaaccatgcacactacaggagcaggcccagggaacatgccagaagcaggaggcaaaattcttctctgccagaatctctctccagtgccttgtagtgaattagtgctagctggtggaagaaaaagagttaagattgcagatttatttcaacaaggcagtaaaaagggtgatattggaactgagaggcaatggatgaatagcacaggcatccaactcgaaccaggcaatatacagtattctctccattaggacagaagagtcaactcttgatccagagagttgagaactaagatgttccttttctccttaactgcctcccctgtaaacctacacacacaaacacacacatacgcaaaacattcagtacacagtggtgtaaccagaataggataactgtagtaaatactcccattttaaaaagggaatgtgagggagacagcaacagtcaccacccatagcaattgtgcttggaggactgtgaagttttcatcccctaaggtggaggaggactcaagaggaagtcatggttctactcctggaagggctcatttgacatttcttctagattccctgactctactgtcgggaagtttcttccgagggttttagaattgtttcagtaaaagatatgtttacattctgaacttgtggcttcttaggttattcattgtctcaaaaagttaatcagattctgactcatggactctcactcagttccaggaaccagcaaccacacctagacatctgaagagacatagattttagagccactttattacttttcattttttccctcacacctctctctctcaacttaattaaaataccttaaaactcaatctgatctttgcctagaatcactttatcttactgagcgtttgtgattcaaagccttttgtaatcccttctcttacagtttgggctttagaaacagtcggcttttctaaccctgcaaggacccaattttctggattctatttcattccagttcatttctacttataaggaggctaatgaattactgagttcttgtctttcttgtaataccttgtcaatccaccaatagttgctaatatctcagtaacaactgccttttaaattttgtattatttccttctaacactgcaggcacattgtacctgttctcacttttcactgtaaaaaatggatcaccatcttcttagcctcactgttaactgctcaactccttattcaatgccacataaattaggtttttgtaacgtcattaccctacttttggaaccaagattcctataagtcaggagagttaacagatttggttacagtgtaaaagctctaaaatctcaggtacttaaaataatttaaggattatttctcagttaacctaagtctcatacaaattaaagagtcctgttctatcttgaaactacctatctggaacacatcacttttaagattagcatgataaggaagaagaaaaatggcaattctactggaaactttgtgtggactttatatcctgacatagaagacatggaaagagattacaacatatccagatgtggaaaaaaataaattcacaaaacagtattcaaaatttctattaattttggaatctgtgatatctctctcctgcagagagacaggagctccccagtaggtcttctggttctgtgacaaaatacacagggttttacagacgaccttgaggatgtggtgtctgatttacatagggcacgagagattggttggaccaggtgcgccattcacacagtgtgtgaagatgctggccaccccaccctaatcttttgttatgcagatgggttctctacccggccggcaccatgttgcctgcttttttactgcacatgtggtgatgaagaaaaaggaagagggaacctccatgttgaatatacctggcttccaggtatcccttttctattggcacagctgctggcatttccctatgcaagttttagcttgcttatctatgcttgcagcttgatttttcaggctgctttttattaaagggaaaccttaccaaggactctcttaccctcgctgtctgcctaaatcatttccttctagctcctgtatcaccagcccattggccaggagcagccaaatggcccaaacctaacttcaaggaagactggagaatgtagctggcacatggagtacttttggaccacgaactttctctgccacagtataacatatgctgtgtcaaaaaagtatgcctaagataaaatgaaatctaagataagacctgaaggaagagtaagagtcaggtgaagaatgaagggtggggcgcggtggctcatcctgtaatcccagcactttgggaggctgaggcgggcggatcacctgaggtcaggagttcgagaccagcctgaccaacatggagaaactctgtctctattaaaaatacaaaattagccaggcatggtggcacatgcctgtagtcccagctacttcagctacttgggaggctgaggcaggaaaatcgcttgaaccagggaggcagaggttacggggagctgagattgtgccactgcactccagcctgggcaaaaagtgaaactccgtctaaataataataataataataatgagggcaggcatgtttcaggatggccgaccagcatgtgcagggaaagcatggcaccattcggggaacatactgagctgagttaggggaccaattcaaagtcagtcctgatgatagagagacagaacattcgactggacatcgctttgctcagaactttagcaatgttgaagtcataagggacgcacagtagaactgaaagaggaagggacaaaaataactgtttaagatagtccaagaatatgtagtacctacataagtaatctgcatatttttaatgccttcattcatgaaatctgcaaatttttaataccttcaattcattttcagaaatgaatatgtatttcacattagaaaacaagtagaattaattatcatcttttactcagcaattccattttcaattttcttaagggcaataagtaagaatctttaagatagagtgacaatacaatttattgaccgaactaggagacttttgcagggaaaagggttttctctaaatacttacagtaggacaacggctgtaaactggctctttcctgagcaaatcagaatgtatggtcatcgtgtatataagtattatgaaatttgtcacatcattgtttacaatgtcacagtaaataaattatagcaataaataggaattataattatcatgtaaaatgatgacatagtaagcagctgataaaacaatgttatgcctgggtgtgctggtgcacactgtagtcctagctacttgggaggctgaggcaggaggatcgcctgaaccaggagttcgaggttgcagtgagttatgatcttaccacgacacccaagtctgggcaacagagcaagaccccatcactaaaaaaaaaaaaaaaaaaaaaaagttataaagaaaatatttgatatcatgaaaagagttcacgatatgtaaagatagagaaaaaaagtttacagatttatttccattcaatgggtggtagtagaaaagatagtaaaaaaccagccgggcacagtggctcacatctgtaaatcccagcagtttggggagccgaggcaggtagacggcttgagcagaggggattgagaacagcctgggcaacctggtgaaaccccgtctctacaaaaaatacaaaaaaaaattagccggttgtggtggcatgcacctgtggtcccagctacttgggaggctgaggtgggaagatcacttgagcctggaaggcagaggttgcagtgagctgagattgtgccactgcacttcagtgtggacaagagagtgagaccccatctcaaaaaagaaaagtaaaaaactgttacaacttattaaaattggttgactcattgaatagtagaatgatatgtgtgtgcatatgtgtgtgcgtgtatgtatgttttctattttgattcattgttattagtcagcagtctggggatacagcactttaaaaagatacttttggacctcaccaaagtttttacaagtagattcagctgaaggacagctcagagtcaaagaataataattcttcccaaatgtatagcactttcacattaaagtgccttcatgtgcgttatctgatttcatctactcaacagaagacaggtattataattctcattttacagttccagaatcagaatttctgaaagattaacttaattgcccgaagtcaaacagatattttaaggtggggtgagaattataactcacatctcccaactctaagttcaaatttctttcaaagacagcaacctaggttcatcccgggtcactaattatgatgcaatattttattacaggcagtgttaaggggctactatttggttggaagaagcctttggaaaagttgttgaagagtcacgtgcacaagtgatgtgctgagcagactggatcttgcctgatggccagaaaattaaaacaacactgaaattaataaaaattcaaactcccattctgctatttgaatacttcactgagcttaaggatataacatttaggattctttttttttgtagtggaatttattccagtgctagtttatatagtatatataatctacttaatttatcctttccatacatgaacacatgagtccataaaccttttattcatttattaatagactcactatgattatttctgttgaagtgtctagtggggaatgctaagaaataccatgaggaggttgggcgcaggggctcaagcctgtaatctcagcactttgggaggccgaggcaggtggatcgcctgaggttgggagttcgagaccagcctgaccaacatggagaaaccccgtctctactaaaaatacaaaattagccaggcatggtggcacatgcctgtaacctcagctactcgggaggctgaggcagaattggttgaacccgggagggggaggttgcagtgagccaaaatcatgccattgcactccagcctgggcaacgagagtgaaactcggtccaaaaaaaaaaaaaaaaaacaaaatagaaaagaaagaaaaagaaatactacagggaggtgagatgggagatgggaattgattcatcccttcgcatgtcccctgcccattactcagaaatctgtgtggcatcttttcatatgggctttaagttcttcaaggaaccttttaaggatgtggcaatactccctgcaagcacacaaacctatccagggactaccgacttaatcagctagaaacacgaagatcatctctgctgcttctctgaaaattaaatgctaaatttgagaagggtggtgggaattctttgctgatcttaatgaataatgaataatgaaagctgcccggctcctgttgactaagtatatgcttggatttgatcagccatttaatttcatattttggtaattgttttgaatgataccagaattgagggacagttactcacatgagcataatttctagtcctgaaacctggcaagcttgtcttattgacctgacctaaatttatattgttggtttttaaaatttagtattccttcaggtatttcataaattgctttaggtagattttatgtcagatatttcatattttatgttgttctatgactcaatcatttgcagataaattatggaactttgaaatgtttgcctgatcatggcttcagggcgaaaacagaaaggattgctgagctaattccagcgaattttttattaatttattttgaaaatatcaaactttgttgtaattttgttatcaaattgtaagtcatatgattgctttacaacactgaaggaagaaaatgtgcacaaaagagtcaaaagatataggcattgagtgagatccagggttcaaatcctagcttcaccgtgtagcagctgaatgactgagggcaagttagccttatatttcttattttattactcattttaaaaataccaaatttgtgaagttgttgtgattagtatataaaataattcatacagattatctgacgttgttttttcctttagattttacattaaaaatatagtattttttctgctatactgctatctgctatactggtgataacggacattaggagaaacattaattatctgctttagctgaagtttttctctacatcatcaaataattttcccccattaacatgatgttaaggttgtcatctacctcaaaagatgaaagagagcctttcaattctgcaattctgtggctatactggtttaacattttacggcatgacagaagcaaaaatagaaccaagagccccatgagttagcatgtgcagtgacactgaggctccctgacttggggggaggaggtggatttagaccaaacaccaccagacagacacccaggcaataagctgcagactgataaagagatgaatgaaatacaccaatgagcacctagaaaacaccaaagcaaacacaaaacaatatgtgtaaatgacagatttaaaaaagaacatattgcatttttaaaaataaaaaatagtcattagaattaaaatgtaaatggacatttaaaataaaaacgtagacacatatggaacaagaattggtaaattagaagataaatataagaatactaatatcgaaggaaaaagaaatgaatctatttaaaaaaggttaaaactcacctaagtggacactagagccactcatttgatttgtctgttttttgactgccataagattacccttcctggtcactttgtacacttagaggattatgcgtggcccatcatatttctagccaacgagtgattgaatgcgtgtgatgagtatgtcttccaaagtaaatatttaattgccagaacattcttttctgtttgagtgccaacaagatgtcttagctagtatccctgaaaaactgcaatgagcagagtgccattgatatatctaaaataaacatgtagcatgaggaagagaaaaataaaataactatttgatatcttggacgagtgagatgtcaagaatgtttaatacactagcataacctagcccaggaattggtaagctaaggcctgtaggccctggataccactttttgtaaataaagtatcctggaatacagccacagacattcattgatgtaacatctctaactgctctcgtgctacaacagtggaactgaatagtagtgacaggaactgtgtggtccatacagcctacataaaatgtctcccgtaatgaagaaatggagacaataaaaactgcagaaaaagtcacgtaaaagttccaacaggagataatttagaagaaaaaaagaaatactgtaaagaataatggcagataattttcttaaatgaaaaaaataaaaaaataatgacccattaagatttttgtttctctttttgatagaacagattgcagcagacccatgttcctattaggaaaaacttacaaaatcaagatgaaatttgaaatctgtttgaagacatcagaaacagtcaggagttttcctagaatcaagtaactaagatcccagaaagaagaaactgtagcgaggtatgcccatgtcctgtaactgctccacccttcagggaattttcaaacttttggagccaattcaggaagaaggccactgttaagacataaataaactagatgaaaaaaatcaaaactcctagaatagagaggataacatagatatttcaggctgtcaaataatcaaaagaaagttgacttaaatatattaataataaagtagactctgagacaaaaaatactgctaaagaaaaagaaaggggttacataataacaaaagggtcaatccacaaaaatcataaaactgctaatgttttatgtgtataataatgctttgatccttctccattctagaacctggaagaaaagagtaaaaaaggttttgaaatatgtaaagtaaaaattaaaaaattaaaatgagaaatagacaaactcgcaattacagtaatttatgagcctttgtatatgaacacatatagaacctcactatacccaatgatagcaaaatagcatattttttcattggacataggacacttatcattaataattatatactgggcctttaagtgagctcaacaaatttctaaggaatgattgtatgtagagtacgttctctgattacagtggaatcaagctataaatcaataacaaaaagtaaattatcagccgtttggaaactaagatatacttgtaaataagacaggggtgaaataaatcaacctggaaattagaaaatattttgaactaaaagaccaaaaaatgccctatcaaaatatatctgttaagcctgtttagaggagaaattacctaaaggaaagataattttaaataaatataacttaaaaaataaattctcaaaaaacagtaacttatgtaaccatctcaagaagctaaggaaagaataatcagttaaccccaaataaagttaaaacaagaaaataataaaaagatagactaatggaataaaaaacaaatgtaaaataaaataatataaataaaatcaaatttacatttgggaaagactaattagattcatagaattcaaccaagagttaaaaaaatactcatatcaggagtagtaaaagagacataatcatagattttacatatacaaaaagaaaataagaaagaagatttcataagtaggacagaaaagcagtaaccaaaaagaaaaaaatatatatatgtatatatatatgcacacacatatatttgtgtgtgtatatttatttataagttaagctctactaaaattaagatattttatttactattagaaaccactggaggatggaatggaaagtcagagtgaaatgtacttgcaatacagaaatccaataaaggattcatgaagaatatatacaaagaatgttaaataagaagaagaaacacagctaatccaattaaaattggacaacagatttgaaaaggcaactcacaaaagaggatgtcaaaatggttaatcaatacattaaaatgttctcaacatcattaatcatcagtgaaatgtaagtaaaaataacaatgcaaaaacactacaatccccttagataaataaaaaaataaaataaaaacactatatgaaacaaggctgagagtagagtgagataaacgaagtgtgtctatggtatagaatttaagaaggcacttactctcaagtttgctcaaatgcagagttctacaaaaacctcaaactgggtgccttcttaaattttgtgtccgagcacctaatttttagagagacaccctcttaagttcatgcaagttatgctaggttcaaaagtcaatgagggtgtgtaccttttaaatttttctaccttcattgcctcacctgcctcattgtactcctggacctaatgttaagtgttggtgaggataagaagctagtggaactatgaactggcacaaccacctgataaatatgttggcatattctactaaatgtgtacccacataccctaagttttcagctgttctactctttgctattatactcaagacaaataaatacttacgttcatcaaaagtcaaatataagaatgctcacgactgcccaattcctaatagcactcacaagaaaacaattcaaatgttgatccaaaaaatatgtaaagacattttagtaaaataattcaaaaaattctatatagtaacaaagtgcagctgtacatgacatcatggttaatctcatataatgttgagtgaaaggagatgcaaaagatcatattaactgatttatattaattttaacaaaggcacttgtctgtgggattagaagtcaggagagtggttatttgagaaaaagagttgctaagatgagacacaaagggaaacttttggaatgccaataatatcatatttattgatctgaaaattgtaaaaatttattgagctccacactcatgatttgggcaatttttatttattgcttttcataagtctatccagttttgcttcttatatattttcaagctctattgttaagtgtacacatgtttaggcctgctatgtcttcttcataaccattttatcattatgaaatgactgtatatatggtaacattgtttccatgaaatcaactttgtctgctgttaatatagtcactcctggctgggcacggtggctcacgcttgtaatcccagcactttgggaggctgaggcgggtggatcacaagatcaggagttccagaccagcctggtcgacatggtgaaaccccgtctctactaaaaatacaaaaattagttgtgtgtggtggcaggtgcctgtaatcccagctactgcagaggctgaggcaggagaatcacttgaaagcagcagacagagtttgcagtgagccgagatcacgctgctgcactccagcctggacaagagcaaaactctgtctcaaaaaaaaaaaaaaatttttttgtcactcttattttcttttagtcagtgttagtagcatacaaattatttcattgtttgattactttacttttcatctatttgcttatttatatttaaaacatgcttcttattggcaatatctagtaaggtcatgatatcttatccaatctaactatctctactttttaattaagtgcttagataattgacacttaatgtgattattgatataactgtaattaaaactggtatcttgctacttgtaaaaaaatttgtatcctttgcccattttttaaatgaggttgtttctttcttgttgatttgtttaaataccttatagattctggatgttcgaactttgtcagatgcatagtttttgaaatattttctcccatcctgtaggttatctatttaccctgttgatagtttcatctgctgagaagttatttaatttaattaggtccaacttgtcaattttttgtattgttgcaattgcttttggggactcagccaaaaattctttgccaagacccatgttaaaaagaatatttcctagatttttaaagaatttttagagtttgaggtctcacatttaaatctttaatctattttcagttaatttttgtatatagtgaaaggtaagggtccagtttcattctgcatatagtcaattatgcaagcataagtcattgaataaggagttctctccccattgtgtgtttttgctggcctttttgaagatcagattgttataggtgtgcagctttatttctgattgttcttttctgttccattggtctatgtgcctgtttttgtgctacaccatgctgttttggttactatagttttatcgtttgaagtggggtagtatgatgcctccagctttgttctttttgtttacaattgctttggctattttggctcttttttggttgcatgtaatttttagatatttttccaattctgtgaaaaatgacattggtagtgtgataggaacagtgttaaatctataaattgctttgggcagtatggccattttaactatattgattcttcctatccacaagcaaggtatattttttccttttatttgtgtagtctctgatttcttttagcagtgttttgtagttcttgtagagatctttcatcttcttggtaagctgtatttggatttttttttttttttttgacagcatctcatgtcaggctggagtgcagtggtgtgatattggctcacggcaacctctgcctcctggtctgaagcaatcctcccacctcagcctcccaagtagccgggactacaggtacatgccactatgcccagctcaattttgtaccttttgtagagacagggtttcaccatgttggccaggctgttctcaaactcctgagctcaagcaatccacccacctcggcctcccaaagaactgggattacaggtgtgagccactgtggctggacaagggttgtgttcttgatttgactttcagcctagacattattggtgtttagaaatgctactgatttttgtacactgattttgtatctggaaactttaccgaagtcgtttattagttctaggagccttttggaagagtctttagggttttctgggtatagaattatataatcagcaaaaagaaatagtttgatttctgctcttcctatttggatgccttttatttctttttcttgctggatcactctggctaaaaaaagaagatggacaagcagccaacaaacatttgaaaaaatgctcctcatcactaattatcaggaaaatgccaatcaatcaaaaaccacaatgagttaccatctcacaccagtctggctattaataaaattcagaatggcttctattaaaaagtcaaaataataataatcagaatagctattattaaaaagtcaaaaaacaacagaatctggtgaggctgcagagaaaagggaacacttataaactgttggtaaggatggaaattagttcaaccactatagaaagcagttgggagatttctcaaagagcttaaaatagaggtaccattcgacttggcaatcccattactgtgtatatatccacaggaaaataaattatcctattctaccaaaaggacactcacacttgtatgttcatcactgtgctattcacaatagcaatgacacggaatcaacctaggtgtccatcagtgattgactgaaggaggaaaatatgatacatatacaccatggaacactgtgcagctatagaaagattgaaatcatgtcctttgcagcagcatagatgcaactggatgccataatcctaagtgaattaatacaggaacaaaagaccaaataccacctgttctcacttttaagtgggagctaaacattgagcacacctggacataaacatgggaacatagacgctgtggactactagaaggggggaaagaagaggagagcatggttagaaaaactacctattgggtcctctgctcactccctgggtgacaagatccattccacaacctcatcatcatgcaatacacccatgtaacaatcatgcccatgaaccctctatatctaacataaacactgaaatttaaaaaaatgttccatctgttattctgcttctctctttctgaattttaattgaatattagtttatggttatatcttttttgacttattagtcatgataacttgtgttattacattagtggttgctttagagttcacgtatctttacttatatatctttaacttgtaagagtgtaagttcaagtggtactacataacttctcatacagtataagaatcctacaaaaacatacttccatttctcccctccagaactttgttctatggctgtcgtacatttcactattgcatattttagaaaccctgcaatttcattatcattttggatttaagatttgtgcaaatttatatgtatatttactccagtacaaatttactaaaaataaaaattttaatatatatctaaagtcaaaataaatgttattaaatattcattgtaatgaaatttttttaaaactcctaagcacaattagcacatacttaaaattgaatcatagaatcacaatgaaaaccctgaaggttaaaatgagtgggttgctaacaaaatagtacttgaaggaaatcagtggccctagctacccttatcagaaaacaaatcagttctgaaacaaaggagccaagaattcaactcaagatggaagaaatagaaatgagtaaatttaaaaaaagaaccagacacaaatgatgaacatgtaatcaaaaatgaacagaatagagaaagaaatcaaaaaatgtaaaaataaaactacagcttggtttacaaagacaagatagacaaacttctgacaagtatgattaagagaaaagaaagattagagtagctataatgataaaatcaacaaaagtttttaaagtcttggaaaggtactatgaaatatacatgattgaatgcatatgacatgaattaatttctgaaaataaattaacaaccggattatgaagaagaaaaatgaaaatcaactagactcgatttttagtatacttaaataggattccaaggctttccctccatagaagaaaggttttaggagatacgactttatatcaaacatgtaaaaatgaaaaattcaataatatatatgttattgtggccatggagaaactcctgctggtgggagtgagacatgaagccagggttttacaaaatagtctagcattttggaatgaaattaagtatacatgtgcatgctgtatcaaatctgggtaaatagagctatacagtttatacgaaacaagttacaaaattatcccaagcaacattgttggtagtagcaagaaattatagactattaatgggtccattaactaggaaaatatataaggaaaaagttataaattctgtattagggttctctagagaaacagaaccggtaggatttagatatagataggtagatagatgattgattagatagatagatagatagatagatagatagatagatagatagattagatagatgatagagatgatggatgatatagatagatatagatataggtagatgatagatagatggatagatagatagatgatagatgaaaagagagtgagagaggcagataaaatgaaagagataaattctaagacattggctcatacagttgtgggagctggcaagtccaaatcccacaggacaaggcagaagctggagattcaagtaagtgttgatcttgcatacttgagtgtaaaaactagattcaagcaaaatttctattgtagacttgaggcagaattccttctttgggaaacatctgtctttgctcttcaacagatcagatgcggtccatccatgtcatggagagtgatctgttttacttaaaaccaaccgatgtgaatgttagtcacacattaaaaaatagttttgcagcaacatcaaggctagtatttgaccaaacaattggtcaccattgtttaaccaagttgacacataaaattaatcatcacatatgccaaagattactatttagcaatgagaagtaaagagctacattttcatagagcaatgtagcagcatttcaaaatgttagtgaaataagaaattgaatggaataacaattaatatttacataagttaaacatgcagcatataacactgaacacatctatgcacataagtgtgtatacagaatgaattaaaacggtatagattgttgaaaataaagtgcatgtctagaaggaacaatacaaaggcaattgggcacaaaaagaaaaaacatgacatgaaacattagaggtgttatacatggtctgatgataagggcaatcaatctagtaattaggaactaagcagtatgattgtctccattctgtgcgtgtgggatctgaaatcaagtctaaaatctgaattcaacacactgaaaaataatctatttttatatattttattcaatattttaataccttgaaattaaaggacattcagtgaatgtggtaaatatatctactaaaatcctacagaaaattttactctttaatgctgagttcagccatttcctctatcatcacattgtagtgaggggcctagccactaatgcagaagaaaaaatttcaataaaatatgtaacatttgggaaaaagttaaaatcttctcgtttttctcagatagaggtatgtcaacaaagtaaaatctcagggaatccataaaaaatatttagatatactgtgagaatttgggaaaaaatgttagattaatatataatggaaaatatcaatatataaaaattaatcacattactatatagcagcagcaaacaatcagaaaaacaatttaatcaattacatataaaacagaagaaagaaatcaggtaatcatcctgtaatatatttaacaaaaatttgaatgatctttcagagtaaaaatatcaaatttaattaaagaagcttttccaatttcaaaacaaatgtagatttatcccttaataaatgagaagaatcaatataatgaatcatcaattcttgtcgtattaatctataagttaaatgttaattcaattaaaatgttgaaagattttgttttcttggattttaagagcttaactctaaaattcgtatggaataataaaaaacctagtacagtcaatataactctgaacaaaaacatgtttgaggccaggcacggtggctcacacctataattcctgcacttttagaggccaaggcagaaggatcactagtggccaggagttcgagaccagcctaagcctcatggcaagacccttgtaacttaaaaataaaaataaaaaattagccgattgtgtgtcatacaactgtagtcccagctacttgggaagctgagacaggagaattgttggagctaaagaattggaggctgcagtaagctatgattgtgccactgcactccagcctgggtgatagagcaagatcttgtttcttaaaaaaaaaaaaaaaaaagaaaagaaaatgaaagatggtagaatgggactctcctttgcattgtattaatggaatattcaacagtgtccctggccactgcccctacaggtgtgatgatcgaaatgtctccagacattgccaaatgccctctggagggtaaaatgtcctccattgagaaccacagagttaaattaattaaaaccatttgattttagcataggtatagacaagaaaaataattataaagaaaaagaaacatgaatcagacctacattcatagaaatttggtgtatatgcaatggtagtaaatttaacaggaaaaagtttagtataaggttctgcaacaattagctgtttatagaaaacaattaatgaaatagatttctgtgctatacacataaatctattgattaaaaaactaaatgtaaagactcagttgaaaagctaaagcaatatataattttttatcagcactttctataaatcgatcttagaaaaatttcacaaatgtattcaaagggatagttcagaagatattcattttggcacagattgtaatagcaaaagcatgaaaacaattttactatccattattaagacaaataaactttatgtttaattcagtgggacactatgtgtctgttaaaatgaattagctagatttaaaaatatcaatatgaataagcctcaaaaatataataccacaagaaggaagcaaatattgcaaagtatacttacagtaaggtaccatatatttgaaatgttaaaacactcagaaacaataatatatactgtttatagttgcctacaaatgtagtaagtacacagaatcctgagagaaaatattccctttctggaaatggagggacaaaaaaggatgatgtgagatttcagttacagatgtacttaagtcgttaataacaaaaaagacttctgaagctaatgtagcaatagtttagtatttattaatctttgttcatcaaacataataatcttattgctctctgtttttatatgtggaagtgtgttcataaaaaaggtattcttgtccaattgattaaaggtattttaatatttagtaaaaaaaattaaatctacttatacaaacacaataaaatgagtagttcaacatccagttctgtacctaagaacccaaatgcatgcctttcatttccatgcttcttctaaaaaatgtccctgcctggaaatgggtgttctctggtttgaccagaagtggtttcacatttctaatatggactgacttgcaatatgcactttccattttctgtttcttacttagaagagtgtttgcttatgagatcatcattacaacacacacaaacacccaaagtcttctttttttctttgatttgttatttgtcaggagagatgaattaaaatttaagctccctatttcagataactggtaaatctactctgtttttctttcctgtttattaatgagcttctgtcactttttctctcctttcttactctttccttctttttctctcctcaacacattcatctctgtgctcatttgcttcaataccctttcacaagacttatctttttcttctaaagccaaaataatgatgcacattattcttatctgagtttctctccacttctctatttccaggtcagatttagcttaacaagtggatcattgattggatgtttacacagccacattggatctttattgctctgttcatttgtcttgttcaggggaaatgggattagctcttctttaattgtgtcatctctaaagatgcccaccaactcttttaaggtttcgggtaaatgtgcagcgcataatatttcaaaatattttttaaataattcaactgaaggccttttgcttctttaacctttctttgttgacttgaaaacaaatgaaaatgtaacaaaaatgcagggtactacttatcttgctttccgcacagtctgactcaacattttcttagttgttaaaaagatgtagacacaggattggagttgatagttgatggctcttagtttttattctattagggagctacttctagatcttatacccattcaagctcttatcactctattttatagcttttctttccttgtacaacttatgctcatatctataaactacaggtaattccatattatttagaaatataaattatctggttgaaatgagccaaatccaccactcttgttttattttcatagggtaaggatcagattcaagtagagcttgacacaagagaaagtcattatcaaaaagtcaaaacattagtgttgtcaaagatgtaaagaaaacaggacccttatatattcggtaaggatgtaaattagtacagtatagagattcaacaaaaaattaaaaatagaactacaaaatcatccagaaatcctaatactggctatatatcccccccaaaaagaaagaaaatgaccatccccaagagatatctgcacccccatgtacactgcagcattattcaaaatagccaagatatgaaaacaatctaagcatccatcaatggacacttagccattactcagccataaaaaaggaatctaccatgtctgaaaacatggatgaacctgaatgacattatgctaagtgaaataagccagacagaaaaacaaacgctgcataatctcacttatatgtagaacctaaaatagtcaaactcataggaacatgggatagaatggttattgccaggtgctggaggttggggcagatggggagtggttggttaagggtctccaaactttcagttataagacgactaagttctagagacttaatgtaaagcatgatgactagagttaataatactctattgtatacttgaaatttgctaaaaaagtagatttcaagtgtccttatccccacactcccacagacaaatggtaactatgtgacataatagacatgttaattagcttgatgtggttatcatttcacaatacgtatgtgttatcaaatcatcatgctgtacatttaaatgtttacaatttttgtcactaatactaaataaagctcaaaaaagggagtcattgctgcaacctctgttaggagtacttataaatctacccaggctttagaaaagaaaaaaaaagccaatgagggtccactctgcagctctactgtaggatttctgaaaaattggtcagtataatgacaaccctatcactgtggagactaagtgctatgccaaacttctaccgacttcagtggggagggcaccagattcaagggtctgaagaagagacccagagccagcaaacgagacctggggcttcattgaggttacacacaggggagagggtccagtggtggtgggatgaacaggagaactgccaccacttggaaaggcatgcaatctatacagtatttttacttagaaccctttccctgaccacctccatttggcaacattcattcaacccaaaactcaggacctcgatcctctgtatctcccatgttctgtgggtcaggccgggggctcagatgtttctcatagacaggaatgaatctctagtttagccactcctggattccctagctctagagcacacattcaggtgcatctgccatacagggccattcttagggtatgcctaagatattgcctctcaggtgcatttaccatcacctaggataatcttgattcagcattcctgaagagggcagtgaaggcagtagaacagccagggctactaaatagaagggcctgaaactgactttatagagtaatgtccgaaaagcctggatgtgaggataaataatcatttctccccacaaaacactaaacaaatctcttgtgatgtattggcgagttcttatttgcagtcatatgatgttactattttctattacaaattgcaaattcaattctcaaattcaattatcctggagacagccaaccaataagtttagcagtgtttgaaaagaaagacaagttgcacccaggtttataaatacacatgtagacacaaaagtgttaaatgtaagcctcagcaaaattgaaaatgggcaatttctagatccagattgggccagaagtgggagagaggatttttggtggagagacataagagactcctggatctgtgtgttttctggaatagcatttccaaatgattctccaggaaggacacattttttattatcattcacaaggcattaacatgtctaagattccaaaaattcttaaagaaacatcttttttttaatcatatgtctttaaaagaaaaaaatctctttttactttgtttactatcatgccacatattcgtttcaccacaaaacactttttttaagaattcttattaataacacttcttggaaattttgcttcataaagctctcctagggagacaatgatgcagagtaaataaatttcaggttatgcaggacataccattgaatataagatttacaccagaagatattttctttccatgaaaagccacaaacatttataaaacatatttcgaggcaggtctatttaggaccttgctattcaaaatatggttcttggaaaaggaaggttagcatcactgtggatcttgttagaaatgtggaaactctggtcccacctcagagctattgaatgagaatcttgcattatctgcaacatccccagctgattcctgtgcacaaaaagtttgagaaagtctattgtagaagactcaaacttctaaagttatgaatatcacacatttctgcatgtaaattagaaaacacaaactagaaacatgtaattaaggttaattgcacttatcttttaaaacgtgacgattaaaacgtgagcattaaccaattgcaaagcataaacaatgatattaaaatatcatgtaagccttgaataggtgaccagtttgaattcatatatatcagcatcagatctggatctaaataactggataagaatatattaggaaataaggagaatgacaaaagccatggacaacctggcataaaaccacaactctcgcttgattaacacaaaacaatttgctagtgagtagagaaagacatttaatggcatgaatgtgccacggctacattgacacgtagtatacagaatcctcagtttacttacactcttctaatagtgccaaatgtcaagtttagaaatattctaatggtttgaaaatatttatttaacatttatttatcactggttaattatatcatttcaaaaatgctttctttggattagtgctgtcctcagatcagttagacataaactttccaatcaaagggaacatcatctagtatactggatgaattataaacaatctaccacgttgaaagcacacatattacaaagttatagcaagaagtttcaggaaacatacatgacaaatattgggtgtcagaatatgattaaggatctggaaaaagctcagtctcattatttatcggtgtatcctcacatcacatcactcggagttagtgtagtctgtaggttagagggtggagtaggagactccctctcttccaaagtctctgtgttagtcctttttgagttactgcctttctcattgaaccactgttcaatgatttttctgaacaatggtcctctgaaggcagtagcttcctagtggacgagtgtctgatttttcccagcactacctagtacagagctgggctcagagttcatacttataaagccagagataagagatcttgaagaaagaattatgagcgattcaagggtaatacattggcataatttaagaatagaaagccagctctgcaagcaatcagactaatggaagatctgagccaggaaactctctctctctctctctctctctgtgtgtgtgtgtgtgtgtgtgtgtttgtgtgtgacttcaaacaatttggaagactcggtgttattatactaattttacttgagtaaagttatacctagagaggttaagttcacagctagtcagtgctggaattagggaccaaacctggttctgcctgactgtaaaactaggactcttcaatcactcttttgcagggtttcttaacctcagtactattggcaattagtgcaggataattctttgttgtggagggtcctgctatgtattgtaggataattctttgttgtggagggttatgctatgtattgtaaaatgtttagaagcatccctgattgctacccactagatgtcagaagcacattacccaccactacccccactgtgataacaaaaaatgtgtccagacatggccaaatgtctcctgggagaaaatcatccctgattggaagctactgatctattaatagtaggtccgtaggatccttaaagtgagcatgttacagtaaatcacctcctgaacatgaaccactgacacaaccttattaatgtagacagcttagtgggcttgcctatggtcacttctgcttctaaaagaaatagaaatcttttttttttttttaaatactttaagttctgggatacatgtgcagaatgtgcaggtttgttacataggtatacacgtgcaatggtgttttgctgcacccatcaacccatcatctaggtatttctcctaatgctatccctcccctaccccccaacccctgacaggccccggtgtgtaacattgccctccctgtgtccatgtgttctcattgttcaactcccacttatgagtgacaacatgcagtgtttggttttctgttcccgtgacagtttgttgagaataatggcttacagcttcatccatgtccctgcaaaggacatgaactcatccttttttacagctgcatagtattccgtggtgtatatgtgccacattttctttatccagtctatcactgttgggcatttgggttgtttccaagtctttgctattgtgaacagtgctgcaataaacatacatgtgcatgtatttttatagaagaatgacttataatcctttgggtacatacccagtaatgggattgctgggtcaaataatatttctggttctagatccttgaggaatcgccacactctcttccacaatggttgaactagtttacagtcccaccaacagtctaaaagcgtttctatttctccacatcctctccagcatctgctgtttcctgactttttaatgattgccattctaactggtgtgagatggtatctcattgtggttttggtttgcatttctccaaaggccagtgatgatgaactttttttttcatgtgtttgttggccgcataaatgtcttcttttgagaagttatctgttcatatcctttgcccactttttgatgggtttgtttttttcttgtaaatttgtttaagttctttatagattctggatattagccctttgtcagatggatagattgaaaaaattttctcccattctgtagattgcctgttcactctgatgatggtttctttccatcaatgatagactggataaagaaaatgtggcacatatacaccgtggaatactatgcagccataaaaaaggatgagttcatgtcctttgcagggacatggatgaagctggaaaaacatcgttctcagcaaactaacataagaacagaaaaccaaacactgcatgttgtcactcataagtgggagttgaacaatgagaacccatggacacagggagggaacatcacacaccggggcctgtcaggggttgagggcctaggggagggatagcattaggagaaatacctaatgtagatgacgggttgatggttgcagcaaactaccatggcatgtgtatacctatgtaacaaacctgtacgttctgcacatgtaccctagaacttaaagcatcatcatcatcataataataataaaggaaataatagacagtttatcttaggtaaattgtttttgaggtcactggcaataagtgaaggcctttaattttgcccatctgggccatgtttcacaaatattactgaaaacgccttttcaaaatagcaataaaggctaaggtatcagggactctgtagtattttttaatataaaacaaaacaaaacaaaaatgtgaaaatagctgtaacagagcttaaggtccagtctgaatttaggtgtgggattgaaccatttctttttttttttttttaacagaaatcctcattctttggcccatatcttttttttttattattatactttaagttttggggtacatgggcacaatatgcaggttagttacatatgtatacatgagccattttggtgtgctgcacccagtaactcgtcatttaacatgaggtatatctcctaatgctatccctccctgctcccaccaccccaccacaggccctagtgtgtgatgttccccttcctgtgtccaagtcttctcattgttcacttcccacctatgagtgagaacatgtggtgtttggttttttgtccttgtgacagtttgctgagaatgatggtttccagcttcatccatgtccctaccaaggtcatgaactcatctttttttatggctgcatagtattgcatggtgtatatgtgccatattttcttaatccagtctatcattgctggacatttggcttggttccaagtctttgctattgtgaataatgccgcaataaacatacctgtgcatgtgtctttatagcagcatgatttatagtcctttgggtatatacccagtaatgggattgctgggccaaatggtatttctagttctagatccccgagaaatcaccacactgacttccacaatggttgaactagtttacagtcccaccaacagtgtaaaagtgttcctatttctccacatcctctccagtacctgttgtttcctgactttttgatgatggccattttaactggtgtgagatggtatgtcgttgtggttttgatttgcatttctctgatggccagtgatgatgaacattttttcatgtgtcttttggctgcataaatgtcttcttttgagaagcgtctgttcatatccttcacccacttgttgatggggttgtttgtttttttcttgtaaatttgtttgagttcattgtagattctggatattagccctttgtcagatgagtaggttgcaaaaatttcctcccattctgtaggttgcctgttcactctgacggtaatttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtccttaatccatcttgattaatttttgtataaggtgtaaggaagggatccagtttcagctttctacatatggctagccagttttcccagcaccatttattaaatagggaatcgtttccccatttcttctttttgtcaggtttgtcaaagatcagatagttgtagatgtgtggtattatttctgagggttctattctgttccattgttctatatctctgttttggtaccaggaccatgctgctttggttactgtagccttgtagtatagtttgaagttacgtagcatgatgcctccagctttgttcttttggcttaggattgacttgacaatgtgggctctttttttgttccatatgaactttaaagtagttttttccaattctgtgaagaaagtcattggtagcttgatggggatggcattgaatgtataaattaccttgggcagtatggccattttcacgatattgattcttcctacccatgagcatagaatgttcttccatttgtttgtatcctctttgatttcattgagcagtggtttgttgttctccttgaagaggtccgggattgaatcatttcaaacaaaatatcaggttctcttttatgttgcagagtggggctagtaatattgcccaacttcaaaggtgaggagagtctcttcctgaacatgcagaaagagggtcacccaaaatcatttggagtagtgacaatgacattggatttggagtcagaaagaaggcctagattacctcctcaaatgattaccatctctttgaccttctaggggccaatagtctctgagtttcatatttgagcctcagatttgtgtaattgcaataatagtctctatctcatagagctaaggtaatgattagatggaatgttcagtggaaaaaaacgacttctaagcacaaatatggcttcaaacattaagctttgattgctccaaaacttacaattaattgcttacatcgcattttgcaatggatagaaatggccagggggattatcgcatagggaaataacacaatgctctttcaaagttttctatcaaattaagactcttggaagcaaaatgatcttaggccccgtgactacaccatgtaactaaatttggtctgattttcatcttaccctggcataaaaatgagggaaagcagactcaatcaactcttcagccacctcccttatcccacaccatgataatggattcaatatctctgtgccttagtctcttcaggctgctataacaaaatggcttagactaggtaatttatacacaaaagtgtttattgctcacagttctagaggctggaaagtccacaatcaggataccaggagattcggtgtctggtaagggcttgttactcacagatggagaccccttgtagctttctcacatcgtggaagaggcaagcaagctcccacaggccttctttataaaggcgctaattctattcatgaggcagatcccttataaccttgtcgccacacaaaggccccaccttttaataccatcactttagggttagatttcaacaaataaattttgaggagaaacatttaaatcatagtactctgcccatggcctcccaaaatttatgtccttctcatatgcaaactatattaattccatcccaatagcatcaaaagtattcacttgttctagcatcaactcaaaatttaaagttcaaagtctcatctaaatcaggtgtgggtgagactcaaggtacaactcattctgagagcaaattctgctccagctgtgggccagtgaaatcaaacaagttatgtgctttccacaacacattgcacaatcattcagacctcaggactggcccaacttaactcaaaaaacagacacgttttccttccaacttgagttgttgcaagatactacctgctctcctttagaaactagtaatcacgggatacaagaaaacgaagcacaggaagtggaacaccttaagtctctgccatgtcccagaccagagtcagtgaggatacatgcatatgtatgtgaatattcacctttatgtatgcacatacgcataggcaagtgtattcatcagtctgcatgtgggtgtttctgcacaagcatatgcatttgtgtgactatttgcgtgggaatgtgtatgtgggcatatgtgcattttagtttgtgtattcatgtgttggtatatgtgggtgtggatataagggtagatgtacatatatatctgcagatatttgttggttgaatttgcatagatttctgaatatgtcatcagggtggaagtgggaagaaggagaaaatggaaatagaatgaaattctctcattgaacctacagtgggaatttaaggaaacagcatgctattaaccaaatcaggagctggtctacagtcacctcactgaggaatgtgggaagaacacagttgaaattatctttaaacatcagcaaaaatagagttacttggactctggatttcatgttgaattttctctagctacatggggcttccttataactataaggaagttgggtggtaggtcgtagctgctttacagggaagagttgtatccagaataagcaaaataagactaaaaggtaaaggcatggggagcccaaaagtctacccaataactctagtagcttattctgtctttcaattgcggaggaagtggagcccaggccaaggcagcattggaaatattgtgttaatcccttccttccagccctcagaacaacccctgaatgagatcccaatatactgggaggcaggaaaaagaaagaaaccccaatttcaatacaggaatattaataatagtagcaaatacttatatggtacttagtatgagcaagcaccatttaaagagttttagaagtcattattgcttattgttgtcatttatgaattgccaattgtatatcaggcactttactatgtgcattaaagatatgattccatttacatttattttcataaccattggttgaagtctatattaataagtcagttttactaaggcagaaactcaggctcaacgacgttgagctatgtgctcaaagtcatagtggtggagcaatgatttgaacgcaggcctattacaaattgtctttattttcagagttagttttctaaactacaatcatggtacctaggtttgatttgataatgcagaagcaatatgtgatagccaatttttctctttatcctagcaagggaaaacattacaaagcaatttacaaaattcagtatgttcctaccacattcagtttccatatgcatattggatggaagttagctgaaactttcccctagatatctgaactgcagaatagtgtacaattggccctccatatctatgggtcctccatctacagattcaacgaactgaggttttaaaatgtttggaaaaaacataataaaacataacaatatacaaataagatcaatacatttaaccactatttgcatgtcacttccactgcattaggtattacaagtaatctagagataatttaaagtatacaggagaatgtgtgtagatgatatgcaaatagtacaccattttatataagagatttgtgcattcgtgaattttggcatctgcagtggttctggaacaaatcctgcaaggatattgagggacaactcgaattcaggacagttcaaaccaaattagaagatcaagtacccaagatgagcatggctcactttacctattagctcttcctgtttgcatgaactgggaaaactgtactgtcatacttggatgtagatgaaacctagaaatgctaggaatcttcaaacctgagagaagtatatttcttatgcccttttttgagtatgtttctattaagagctgtattttgtgacatgtggtgagacattaattgccatctactacgtgtttccttagcaccctgctctaaacagcattctacagtaagggatggcttgttaataaaggttaccagttgatattaatgctaaatattgcctcatttatactattcctactaacccaagtatgtggatatggggagaggggatgtgctttttaattaaatagtcaagaacagaaaacactgagctctatgagaaaggtaaaagaaaaaataggaatagctgctattctagcatctaatatgttactaagtcagtaaaatacatgatttctcctcttatttgcgtaacttaaataactgaggtaatttggtatctggaaacattgcagctccctctcttttcattctttggccagctgaattaactaattgatatggttaggctttgtgtccccaccaaaatctcatcttgaattgtaatccccataatccccataatccccctgtgtcaagggagagaccaagtggaggtaattgaatcatggaggcagtttcgcctatgatgttctcatgatagtgagttctcaggagatctaatggttttataaggggctcttcccactttgcttggcacttccccttcctgctgccttgtgaagaaggggcctgcttccccttcaccttctgccatgattctaagttccctgaggcttccctagtcatgctgaactgtaagtcaattaaacctctttcctttataaattatcctctcaggcagttctttgtagcaatacaaaaacgaactaatacactgatgaatatagttttccatttaccctggataagacctcagaatccatcttaacacagcatgtcagaaagccatgccaaatagatgattaccactctgtgagccctagttgccaactctgtcatagattattgatctgaggagagaaggagaaagaagtttcacagatacaacatttggcattcctgaaataggccttgctatttgcccaacatataactaagacgtgaaattctagtaggtctgaggaaatagtggcacctgttggtgccattccagaccaagacatagacttcattcaggcttggatgataaatggtctattgcagataaagatatgtatttcaaacaaagcgttttttatttactgaaattattaaatttataacttctgatttgaaaataagaatcttatctatcacacttttatcttatgggcattactgtcaagcctatctttatgttacatagatgcactgagcttttggccagataccattaaatgtttgacttctgaaactcacctgcatttctgatttcctgatcaccaaatatttgcatgtttgtttgctcccctttccttacagggggagaatgcactgagcatgcatgctaatgtggccattctgctttacaaaagctttcttttctctttcattgtatgctaatctattgcaagtctgataattttcattcccttaaaacttagtttttcacaatctgacaagtaatttttctgagttttttttctgacaatggtagatccagagtctcaataaacttcacccagaatcaaatttctggagtagccatctgcttctttcattataatcttggtataagcagtatagctcggtggttaagaacaaagaatttggatcagacaaattggatttttgcaactttctggttgtgtgacctttggtgaatctcaaaacctctttaagcctcagttttggcatttgtgtaacagtagtactggtatgtatttgtgatgctgtaagcttgttgtgaagatggtatgaaatgatgaatagatatggtcagtagtcctgtttgttagcaattggtatatattagttgttattattccttgtttaaaactccactgacattaaatagccacatgaagagcatggtgacatgtgaacagtatcatcttcctaatgattttatgctcatgaaacctaaacttacttttgtgacttaaaattgctacaccatcaacagttgaagcttcttgatggtgagaaatctattttatgtagaattacttaaaaggacattttaactatagtagcaatttcaattgacttcctgtcatttccaagtcactcagtgtcagcctacattcctcttcagggaactagttcctcccaagacttctcatgtcaggttggcctagcatgatcggaaaaaaatcacaagttggctgtcaatcatccaaaagcatctcttcagcacctaaaagggcataatgctatgctaactactgtgagaagtacattacacagacatagccatagtaatccagcaacttctattctccaggcagaaagagaaaggatctttgtgcttaataaaaagtggtatgctgtggtgaaaggagcattctcttgtgttaagagaccaggcttccccaggtttgtccttcagcaatgcattttacatttctgaatatatttcttcattgaaaagcagaattataaaatctgcgtacccccagtgttcttaatcctttaaaaaatgtttgcaatgtgccatgaatatatacatatatatattaaatataaacatatttaatatattaaatataaacatatttaatatattaaatataaacatatttaatatattaaatataaacatatttaatatattaaatataaacatatttaatatattaaatataaacatatttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacatattaaatataaacatattttatatattaaatataaacatattttatatattgaatataaacatattttatatattgaatataaacatattttatatattgaatataaatatatataatatatattaaatatataaaaattatataattatataatataaattatatatattaaatatataaaaattatatataattatataatataaattatatatatttatatatttaacttttctgcaaaaaaagatgagaagaaagatcaaaaggaataatagcaagtaaaaaaaacagtgatcagaacagagaggacatgagcaatactagctaattatgactatcagtttttgaatttccactctgagccagatcaaaaacagaatctcaagcaagttagttggggatatggtggaatttactgtatgttggctagaggtaacaatgtagtaaattgacaggagagaaaccacacttctgggtgattattttgaagttcctgagtggagatataaagcagaataatgttgcagggggattattggagcttttttcttggtattagggactttaggcaagggtctaagaggtctctaaaataagtggttttggggaactcctggtattcatttctcattagctctgaggttctggagacaggaccaagtaatcctcccctcaactttctggagcttttttgagaggagcaaagagataaaatgtcccacagtggtttcccattgctctaaggatactgtattagtctgttctcaagctgctaataatgacataccggagactaggtaattaataaaggactgaggtttaattgactcactgttccacatggctggggaggtgtcacaaccatggcagaaggtgaaggaggagcaaaatcacttcttacgtggtggcaggcaagagagcatgtgcagggaaattcccctttatacaaaaatcagatctcatgagacttattcaccatcaccagaagagcacgagaaagagaaagacccatccccatgattcaattacctcccacagggcccctcccacgacacctgggaattatgggagctgcaattcaagatgggaattgggtagggacacagtcaagccatatcaaagacaaagtatttcccttattttacaactaaagaccctgtctccaaaaattcccattgctctccatgctccaacctcatcagcaaatatttgcaatgtttctaaagcacaatgtttcaggctccctcctgacacagtggacttttgcaaatgatgttccttctgtctgagaacttctttccttatttttgcttaaccatcccacactcaacctgtctttcagcttaaatgtcaattttgcaggaaagcatcctctgggtcttcagactaaatatgatcgcagttataaattctcaagaacacctggtcagttcttttcctagatagccaaaatgtttgaaatcatggaatttctgcatgattgtttggcctggctatcccattaggctgcaagccccatgacagcagagcagtttaacttcatacctaataaactgtctgcagctgctcagtaatgatagctgagtatgtgaatgaataactgagtaaataagcaaaaaaatcatatactttaaaattattatgttggttacacatattcattgtagaaagttttaaaattataaaagtatgaataggataaaaaattttagatctatcacataggctaaatcatttattatatttttatttatgattttacttatttatgtattaataaattatattatttaagaaattataatttattctagtaatatatatgcttatatatctgtagtatatatgtatatatatgtgaatatgtatccatgtataattttggatggtagggcatatattgttcataaattttttattacaacttagaaatatatcataaaaaaattttcaagtcattagatgttctttacccatataatttctaattgctaaatagcattgcatttgtttgtttctttctcaagtaccccagtttatttaactaaagcttattgttggcatttggatgattttaaatattttattataaacacgctagaataaacaactgttttgctaacttttgcatgcctttttcttaggatatatttctaaatgtggcattactgagtctaatattttgattcatactgccaaattgtctttaaaaggaaagtaattctaaagctctcttacactagtgagatgtaatacccagctcaacaatattattcctatactccttttaaactcttcaaagttgatagacaaaatttgtagatttttttttaaattcgtatcttttttattacaaaaagagtggaatttatacataaacacagatagatatgctcatatatttattcgtatatacgcatattcaccatttcaaaaacaactttgtttatgtcgtgtatggatctgttgctgtcctcactcaagttgtttgtcttcttagtgatttataaatgtcttcatatatatttcaaagatacttatactacatttgcagcatgttatattttctgaatttgttgatgtcttttaattttgactcactgttttgctgtaaagtgacacattttaatatagtgaaagttacatcttttattgttctcttcaggtattttatgctctgtgtgtgtgtgttttacatcttatataaagatttcatatttctggtgctataagttatgaggtaacattttccatttttttctccaaataaattttcatttgttccatcaaatatcacttatataaaaattcattttttcatgtgccactcataacacatagcaaatcttatatatatttgactttggcattggattttgtatgcagttttagcggtctactaagctaatagaaaactactttattaattttataataaattgtaatgtgtggtaagttccttattgttcctttttctttattaaagtttttttttttactattgtgatacatttatttttatagataaaaagaactcatcaaatatcattggatagtcattgcacattaaaattagagattaatttatgccattattcaaatctttttatatattgaaaaaaagctgtttattttccttaactgcaatataatatttgtcaagtttattcctaagcattacatttctgttattgcaattatagatgagatttatttcttgtcattacatttttctgagttgttattataatgataggaaaattattgggttttatgaatttagtatgtaattaattacttaagtctactagatttcattttcttgcaaatgattatgaatttgcatcctacttttgtatgattatttctgatgttattttctcttcttattgcttacttaaaaacttttagatcgatattgactactgaataaggaaatatgtcttaattttcaaatttaaggggaatgcctctttagcttgtttattaagttgattgtggagccccagaagaatcattctactcctgaattactaaggatatttaaaataagaaatgttaaattttatcaaaattatcttctaagctatcatgtttctaagactatcatgtagtcttttataaataattttttagataaaagcagtattattttaaactaatgcttacttttctaattcagttaaaactgtctataagtaattccatcagccaaattcacagactactacctaaccactattgtctgttaaccttacaagtaagtcaacacacacttaggttgaaattttcatatctgaaatgccatatacagacttgcaacaagactaaaaaaagaatacactaaggttcagagaatgaaagtagatcttcttcctaggttaggggaatagggtcaatggaattgaccagatagcacaaagcgattgtaagtttcagttagggcacatatattagtgatggtcataaatattcaaaagttctaaaagtaggaggcagaccaaatttagcaacgaagatttagacaaatagcttctgggaaatgtctatgagctgcagagcctgacttacaaagctgggggtttaagtactcgtgcagccctacagcaaggtaaaacaagtagtgctccttaacagaaaatgaatgactcagaaaagttactgatgtaggaccaaaatataaaccagctcagaaacctagccccaccaaaggatcccaggtgaaggagtgaacatgtggttactgaagccctcagaatcagatcacgttagcacctctggggtcaggctgtgagctgggcaggagggaagaacttagagataagctctaagtcactgcagttcatgtaaaagaacaaataatattaaggcctctcagactggcaagatatggagcctcttactatgtcttgtcatcagcctattttctccttggaaataaatctgaacttacatagtccagtggatccagtcagggggaacccataagaggtggagaattgaggcagaaaactgacaggaatcatttaatgagttcttgcttttcaaattcacactcaaactgaaggagatattaacatgtctgtattgagcattctggaactggtgaaggcacaggcttcagaaaacctgtatcctattcactggcatgacacagtgtgaggaggtaaatcctacttgtaatgcttggtgatgctttcatctaaactgtcattaaaactgaactatttctacacattttggtcacttgtccttaaattattaaaatgctaaaaatgtgtctatctgagcaattaaaatataaatcatgaagaataagccgctctttaagaaaaatccattatgacaatttgggaaatgcagtgcaatattgaaaatgcaaacaaaaattcgagtgcaccttatttcaaataaaataactatccacaattataatgcacatttgtttcccccaatgtcctaaaatcacagttatcttactatatctaatacatgatacaatttaagagtagattatttgaaaacacacaggtaagtgagccaataattaaaagcaatgtagaggcactttctttttttctttcttttttttggcgggggggagatggtgtctccctctgttgcccaggctggagtgcagtggcgcgatctcggctcactgcaagctccgcctcccgggttcacgccattctcctgcctcagcctccggagtagctgcaactacaggtgcccgccaccacgcccggctaattttttgtttgtttgttttttgtatttttagtagagatagggtttcaccgtgttagccaggatggtctcgatctcctgacctcgtgatctgcccgccttggccttccgaagtgctgggattacaggcgtgagccactgcgcccggccagaggcactttcttgaagaacttgaaaccatattagagtgaaggacccctcttggccccatctcatacacatctcactgtttccctttcccatcccataacaacagagagaaatctaccaagtgatttttactgggatccactaagagactttttaacaggtgagagcaatttctcactttcttttcccttcctctcccctaatgcccttatctccaaatatagcctgagaaattgttgggattgaaatctaggaaggagcttcttaaaaagaaaaaacctttgtcatcttatttgattttaacctcaatcctgaattctttgccctcctagagcagcaactcaactcagtaatcagatcctagttttaaatcagaagtgtagttgaagccattgattttatccaatattctctgaataattggttggtacaagaatttcaccacctgtttatagacggtggccagaagttagagctgcctgctgattgcttttttgtgtgttattgtgattttaaactatatttaatgttctgtttgaatgggagattttgccacctgcgggagcattccaaaaaatagcattggctgctgtgtatatcaatgtcagagtcagattcatactgcaaaggggctgcaaaattcatcagtggaaaatggctcagcgaattctgtgaaagcatcttccctgggaagcctaatcctctgtcaatgatacttaaaaagtaacttccattcctcctctaagaaaatcgtaaacttctctcctaggttgtgggctgcagcagacatattagagagattttttgagaaaatatgcctccttcatttgtctcaaaaatggacaaaaacgtagattccactagtcacacacaatacaatattgacatcatactaaatagagtcttgcatcatgttttttcattaaatattgagttctcattcgtttctcttgctattattttaaaaactcaaattatatattattttaaaaccacttatgattatatgaacataattaatttcatgatcattgaagctttatctactgtctactaaatataaatagtgcttcagaaacatcctttttttttttttttttttgagacagagtcttgctctgtcacccagcctggagtgcagtggtgtgatctcagctcacgactgtctccacctcccaggttcaagcaattctcctgtctcagactcctgagtagctgcgactacaggcgcacgctgccacccctggctaacttttgtattttcagtagagacagggtttcaccatattggtcagacccgtctcaaactcctgacctcaggtgatccacccacctcggcctcccaaagtgctgggattgcaaaaacattcttataagtatacttttgttcacatctcttagtatctcctcagtgaatattctacaatattaattatttaaccagaatgtatgaatattttaaatttattagtatattttaataatgtgctttcagaaagaatttatcaattttcattctcattagttgcatcgtacagtctcagtcttactgcagtctgtgcaacaccatggtcattgtttttcaaactttgcctgtttaatggacagaaaagctaatgtttgtttaatttgaatttcattaattacttataagaaatgtctttatatgtttctcagctcttcgtcactattatatgagtattttgttcatgatctttgtccatgtatctccttggtttctctccttgacttgtaagtgctctttacatagttctagtataaacctttgacatagattttgattgtttttcgtcacagaaatgcagaatacttttgaaacttttaatacagttgcacctttttttgagtttgaaatgatggtccttgcttgatttaaattgttttttctttgaatgcctatgaccaaaatatctccccgttaagccagcttctaggcccagaaaaatgaaagttgccttgggacaaaacaggaaaacaggatccatcaccattctaaaccatcagctttgtaaagacatctgagatgattatggcacaagaggcacagagagtaagtggatcttagtccagcagaatgattcctcctgggaccagaaaattcttctcattcttaattttctttatttgttttgcttcctataattactttaaaaattataatgtaaaatattttcaacagaccaaatatgagtaaggatatcatgaacactcatgttatgaatattctgcttaagaaatgatcatcaaaacgatgaaggccccaggtacctcatgctgatcacattcttcttaatgtcctcccaaactagaaaaagttactgccctcagaaagagtttcttatccctaagaacttctttatatttaatcatatagttatatcatcccaaataataggcagaatggttttaaaattgtcaaatatgcacatttccaatttcattaagcagagaacatatattttcacccataattatgttttgaaactcactcatgttgatacctattttactcttttatagtatacattgtataatgttgatggacatttagcttgtggtacattcttattttcttttatcttgttttttttttgctattataaacatagctgataggaatatttatatacagttgacttgtgaacaatatgaatgtgatctcatttacttatacatggattcttttcaataaagatgaaacagtgtgtctgccttttcttctacctcctccacctcgcctgcctctgtcatccctaagacagcaagaccaacccctcctcttcttcctcctgagcctactcaatgtgaagaaaatgaaaatgaagacctttatgatgattcacttccacttagtaaacagtaaacatattttctctttctggtgatttttttaataacattttcctttctctagcttactttattgtaagaatacagtatataatacgaaataagtgttaactgtttttgctattggtaaggcttctggtcaaagtaggctatgagtagttaagtttctgaggagtcaaaagttatacaaggatttttaaccaaatgggaaaagcggcacccctcatcttcatgctgttcaaggatcagctgtatattcttgagaacctgtgagtttgtctagatcagaatacgccattttttagttgactggaatttgcttttcagggtggttctacaaatttaaatttccatttttcattagaatttactattatcacacctttttttgttttgtttttgttttgtttttgttgtgataattggtgtcttattatggttctaattagtatttccatgattactattgagttgaccttctttttgaatgtatattgatcttcacatttcctcttgttcaaattgcttactaatatatcttgcctaatatttactgtggtgtttatcttttcttattgatttgcaggatcttctattataatcagtatattaatctttgtcacttatatgcatggctactatcatctcccagaccatggctaatctattttttattatgaaatatttcattcgcacaaagaatatatatgatgagtatataaggcttgaaatataataaaacaaaaattcttgtgccaaacacctaccttatgacctggtgatgaaatatcagcaatacccctgaaggtcttttgatgttcttttgtctttcctgactatgttaacccctcttttgaatttttaaaaactcagctttattcagatgtaattatatgcaataaatgcatacattttaagtatatggtttgatatcttttgacaagtatatatacccataatcaagatagagaacacagacttgttacctccaaaaggttcccatgcgttcctttgcaagtagcccctttcctaatctccagcctcaaacaaccagtatcagctgtcaatataggttagtcttcagtgttctagaattttatataaatacaatcgtacattatacaaaagtacttggtgtctctggcttgttttgtgcaatatagtgctttgagatttatccatgttgttgtgtacataggtagttctctttgagttctgagtagtattccactgtatgcaacggtttgcatacccactcttctgttgctggacaattaaggtgtttcttattaatttggatcctaaaatatttatatacaagtataggcatatgctttatgtgggcatatcattttatttctcttggataagtacccaggggagaaatttttgggttgtatggtaagtcctatgtttaactttaaaacattcccaacgtgttagtactcatgttacattcccaccagaaatgtagggaggtttcaggtaatccatattcattaggtaggcttagttcaaagttttgttttaattttagctactattatttaaatggacatttcttgaggactaatgatgttgaatatctttttatgtatttattgatcattcgtagatcttcttggaaatgtgtctattgacatattttgtcaattttttcaaagtagattgttttccatttttttctctctttttttttttttttcctggagacagagtttcactctgtcgcccgggctggagtgcagtggcgtgatctcggctcactgcaacctccgccccgctgggttcgagcaattctcctgcctcagcctctcaagtagctgcggttgcaggcacctgccaccgtatctggctaatttttgtatttttagtagagacagggtttcaccatcttggccaggctcgtcttgaacacctgaccttgtgatccacccgcctcagcctcccaaagtgctggggttacaggcgtgagccaccacgcccggcctgttttctttttatgattgagttaagtgtccttcatatagttgggagacaagacctctctcatatacatataggtgcaatatttttcccagttagtggcttgcttttttattttaacggtgtcattaaaaaaatatccatttacaattcacagtgcaatgagttttgacagacacatacacttgttaaaccaccactacaatatatacaaaatacttccatccctgcctccactcctggctggtcacagacaaccgatgatctgccttctgtcaaaataggttagtttgcattttctaggtttttcgatttataaattgaaacattcagtttttatttttgacttcttttactcagcataatgattcattcatggagatccatctatgtggttgcatgttttagtagtatcctaattttattgcaaaatagtagtacattgtgtagatatgctatattgtgtttttccattctcttaatgatgggaatttggattatatctggtttttgcttattgtgaataaaacctctatggacattcatgtacaatgctttgtgtaggcatctattttcattgctcttgggtaagtatctggtaatgaaatgtctggttcatatggtaggttgtgtttaacttaatcaggaacttcctaatgatttcctcatagttgtatcattttacacccctaccagcaatgtatgagaatttcagttgctttatatctcatcagcatttggcatcgtcagcctttttaattttagtttagtaatgtgtatgcagtgacatcgtattatggttttaatttgctttcccctgatgactaacgctgctaagcagcttttcatatgcttatttgccatccttaaaacttctttggtgatgtgtcaattcaagattttacccatgttatattgggttgtttgcgttctcatttaggatttgtaaaaattttttgttccaattttttttttatcagatttgtgttgtgtcaatattttcttccactctgtggcttaccttctcattgtcccagtggtggtattcaaaggaaaaatggttttaattttaacgaagtccaacgtatcaacattttcttttatggtttatattgttgctgttgtatctaaactgtatttccatatttatttctaagagttttatagttttagcttttacatttagtcccatgttccatttcgagttcgcttttgtatgcaatgtgaattgtcaaagtttatttttttatatggatagcaatctttttttttttttttttttgagacagagtttccctctttcgcctaggctggagtgaagtggcaggatcctggctcactgcaacttctgtcccccggtttcaagccattctcctgtctcagactcccaagtagctgggattataggtgcctgccaccatgcccggctaatttttgtatttttagtagagacggggtttcgccacgttggccaggctggtctcaaactcctggcctcaggtgatccacccgcctcggcctcccaaagtgctaggattacaggcgtgagccacggcgcccggccaggatatcaattgttagagtactatctgtaaagaattaaatttaaaaaagtttatttcttctattgtctaggtaaattttataaaaatcaattgacatgtgggtatttatttctggactcctagcttgttacaactatatacatatatatttacacacacatatacacacacactaccgtactttcttaattactttataatacgttttgaaatcagatagtctttcaacttatttctttttcaaacttgtagtcattgtatagccttttcatataatatacatcttataatcagcttatccatttctacaaaaataatagcaaaaaggaggaggaggaggaggaaaaaggggaggaagatgtagaggagtcatatatctggtgtgctttagactggggttgtgtcgaatctatagatcagtttgagagaaccttactaatattgaatgatcaatagatgaacattgtacatctcttcatttatttgtgtttattttattaatgctggtaatttgcagtgtccaaatcttgtacctgctttgttaaatttatatttaagtgttttctgtttcattgatttcactcgcgtccatgtgaagagaccaccaaacaggctttgtgtgagcaaggctgtttatttcacctgggttcaggcgggctgagtctgaaaagagagtcagccaaaggagatatgggtggggtcgttttataggatttaggtaggtaaaggaaaattacagtcaaaggggggagttgttctcaggcgggcaggagtgggggtcacaaggtgctcagttggggagctttttgagccaggatgagccaggagaaggaatttcacaaggtaatgtcatcagttaaggcaaggaccggccattttcacttcttttgtggtggaatgtcatcagtgaaggcaggaacagaccatttaaatatcccttcttttgtgattcttcagttacttcaggccatctggatgtataggtgcaggtcacaggggatatgatggcttagcttgggctcagaggcctgacagttgacatcattgtcagtggtgtttttgcattacatttacaattgctattgctagtacataaaaagacagttgatttttgtacattgttttgcatacataagtgtatctagtaattctaaaaacttctaaaaaccttttaggtagatgttttagaattttctgtattcatgatttatcaactacaaataagacagtttatttccaaattgtatgccttttatttctttgcttgacttaccgtacaggccaagtcctccttttatattattaaacaaaagtggtgaaatttggctgtttttaattagttttatcaggttgagaaattttcccttccatttcttttactattttgttaatagtttctatcattaataggtattggaatttatcaaaaggtttctccgcatctaatgatataatcgtgtttcctttcctttattcataactacggtaccatacattcctgacaatgatagtcactcttaattttttatcagattcttagaccaccatatattttaccatacattatgtatattttaataagaaatagattataaatatttgtatgtttctgaccttatgttgctggtatcttactatatatatcctattaaagtttgtttttcccactcaataatatgtttttaaaatccatctataataatatgtgacactatggtttattttcaccaatctgtaccactcatttatctgaacattacagattaaaatcatccaatttcctgccaaagcatatttggtttgcttaccacttttttgccattacaaactttttcaagatgaaccttcttctgcatgtctccccgtgagtatgtcagtttcctgattgtacattgcttggggcggggattgctggatgaaataccctgcatgtgactacattgggactggacaaagagaaagtaaatgggtgggccaacaacaaaaaaacaacatacccttcagctttgcaagacaatgccaacttcttttccaaagtggttgcaacgatttacattcacacaaatgaatacgattactggttgttctgtatgcatagaactcagtacttactatctgccagtagatgttgatctcaattggtggatccctttgtggttttgttagtaaatatacaccaaggtttcattggtaaatgtcttgcttgctgttgattcttgtttcttttctttaaaatacctattcatatcattttgaggtacactgcaatgatattacattttatagattaatttgagaagtatatttttataattgtgtggagacctattaaaaaaacaatttaattttacctttcttaatgctattacataaggatttatcactttctctttgtatttctgttgtcagatttatctaaaagttattcagttcttaatattttggcaatgcaaatagtatgttcgaattatactttgtaactgtatattgctagtgtgtaagaactcactttatttcaaattttggtcttatgtttagaaacaaagttatacattttgatgattaattttagtaatttgattatggattcccatgcttcttttacatgaatattaatatcaccccagaattgacagggttttctgtcccatttatgacaagtatttattcattttatttttcttacttgaatggctaggactttgaataaaatattgagtgaaaatgatgattgccaatatacttattcatctctgatttttttccccctgctttttttttttttttttttttaagagtcagagtcttgctctattgcccaggctggagtgcaatggtgtgatcatagctaactgcagctttgatcctcctgcttcaaatgatcctcctgtttcagcctctcaagtagctgggactacaggtgtttgccaccaagtctggctgattttttatttcttgtagagatagggtctcactatgttgcctgggctggtctccagctttggacctcaagttatcatcttaccttggcttcccaaagtgctgggattacaggcatgagccaccacacccagccctcatttgtgatttttaaatcaatgcttctaagcttttactgtaaagtctgatggatttttggtagattatctttattaggttagtagagttttcttctagtctatgtatgataaggattttattattattattaaataattgctaaattttttcaactgcttttttccccttctcttgaagagattataagggtttcccccttttaatctgctaagatgggaaatgattaaaatattttctaaaatgaggccaatattaaatttgttgattaattgcccacttagtgctgggtgttctgttagcatctgagaagtatatagcaatgattaaaggaagaatggtgataaagattttattatttttttaaaactaagcaaataaataatatgacatatgacaatgttttgaataaaaatggaacaagatagagattggtaggtactattttaaagaagatgtttaagaattttctatctgatcaaaatgacatttaggcagggatcagaaggaagtgagaaaatgagctatatggacacatgcaggaagcactttccaggcaatggaattggcaagcgcaaaggccctgtggcagaaagaagttggtcaggatggcgaaggggtggcaagtaacagtgtgagtggggttctataaagtcaaagacacagcagcatatctgacctgacaggttctaaatatcagatgcttcattccagggtcttgggggccatggccagaactttggagttttattctgaagcagataaaactctggagagtgtgacttattttttaataggatcctctggcttatttgtggaagatagaaagcgtataagaaagcaaaatcacaagcaaactaatggttagagggctcttgtgtaactccagatgagagaggataggggcttggtcaaataagaaaggtttggggccggacgccatagctcacatctataatcccagcactttgggaggctgaggcagttggatcacctgaggtcagtagttcaagaccagcctgaccaacaaggtgaaaccctgtctgtactaaaaatacaaaaattagccacgcgtgtggcaggtgcttgtagtcccagctacctgggaggctgagacaggagaattgcttgaacccagggggcagagtttgcagtgagccaagattgtgccactgcactccagcctgggcaacagagcaagactccatctcagaaaaaaaaaagagaaaggtttgggttctggacacatggggaatatccatactgacagcaaatacttttatagcacttactatctaccaggcactcttctaagaatttcataaatatgtactcatttcacagcttcaacaggtagatactattatgaccaccattttatatggagaagctgaggtacagagaggtaaaatacctgcacatgtttaaagagtctcagggagttagcttggaggctggggaacatcaaacaaggtctacctccgaaggtggttcaaggccaccaggagcaaggacagggagggagagtccttggcatatggaaactcagaagggggaggtttataggctgtctggggcctcactttagaatggcatgaatgctttatctggctatgattctagggtatgtttcttaggatagaaatctccactctggctgtggatacaagaggattctgttattgagaatagtgaaggaggggtaggattacataatttattcatttgttgctgttagcattacattttataagagtacctaggctctctgatcctgagacctgcaatgtagttttttataatagacaaaaaagagaaagaagtagagtgtctaggattctcgctgtcttctcccatgatcagtccttaatactggatctgaattttctctggcaaatgatacaaaagtctttttctttttattttttgttcatttgtttgtttgttgaaatgaagctctgtgcattcttagtgtgatggcacagaacaccaacttatttttttcttgcataaaactatcatatgtctctaaaattccctcagcatctgaactgcttacacgtttgcccatttccatcgtttccccaaaagtgaagttctccaggccccttatgtactttttgttcatttcagatttatatttatttatttatttatttatttatttttggtttgcaaaatgcttaggaaaccaaagtatgagagatcaagtcattacaaaccaaagcaatgcaggacaaaatccataaggatgatctaggcaataagataatttcagaggaagggagaatgactcttgactgagggaccatggagggctctgaggaggaactaggatttgagcctggatgtgaatattgtctgttttacacaggtagagagggacagagatgcctgcctgtgagtacttatgtcaattctctctgactttagcccgtagcactgcgtatggtttcctcacacattctggtcaatagaaattccctcagtaatcaccaaggacacccaaaatctcaatctcagctttacttcttccaaggacttggaatcaagcatttcctgaaacaattgtattagttggggatagactaaggctgtcaattttgtctttctctgtatcttccctataccaggtacatagtagatactgttggtctgtttttgtgctgctgtaaaggaatacctgaggctgggtagtttataaggaaaagaggtttaattggctcctaattctacaggctgtacaggaagcatggtgctggcatctgcttggcttctggtgagaggcctcaaggagcttctactcatggcagaaggggaagtgggggaaggcatgtcacatggcaagagtgaacaaggggatgtagcacgtgccacactcttttaaacaaccagatctcatgtgctctcagattgagaactcactcattactgccaggaggacaccaagccattcatgaggaatctgcccccatgacaaaaacgcctcccacccggcctcggctccaacaatggggattacatttcaacatgaggtttggagggaaacatcggaactatgtaagatacttagcaaatatttagttaatgcaaaaatacattcccatttaacttgaaatctttagaattgcacttttcatctctagtaagccacatactttgatctattgcactgaacacagtactagatatattactaaatttatttctcagtgaccagctatttgctggaaccagaatcccttcctaattgcagtcttattggctaggtattggcactgcacttagcggaagtgtcacctccctcatcagggtgcaccgccataaatggacagatggccatgggttcagggctgctgtttccctgggtctgagtgtttcttgccaaccaggattgcaaggaagtctggatttttttttttttttgtaatgattttcacctccatgcctaatgctaagcctgctcaatatcaacaatgcctaaacggctaaatattacacaatggctatctggtgcatactaaaagataagttcagttcctagcttggcttttcaaagccattgttatctagtcatagtttccttacgggtgactgttttaaatggcaggaatgacttgagctatgcaaagagacatgagcatccctaaaatatctccagtgtggtgagtgtgtggaagagaaatttgaattaagcagaggtcctcaatctaactggaataaacacttcccatttatgaccaatatttgtcatttttttattatcctaaaataaaaagtaaagtgatataatatttgacataaatagtttcagagtatcaacattgtgctctaactgtaatataaaaggaaagtataataaactgctacaaattaaatttgtgactgatagacacagttcacttaatatgtactgtcctaagcagctggatccttatttttctccttgtaaccccagtttattcccaaggcattttgtacatcaactcttgttttcttctttgccctttattcaaaacttctattgaataccaactatatattggacactgtgataggcaataatataagaattactatctcccacatggctgatatggaaacccacaagttaacccagttttcctagggtgtattatgaataggcagctgaacaaagtttcaaaagcaaatatacctgttacttctgctgtcacaaacatgagagcagttatgggtggggtagtcactggcagggagtctgagggaggtttctgaggggtggggttggtgttcttctcacgtgggtggttatatgagtatgctgcctttgttgaagttcagtgagtttcacacttatgatttgtgctatgtgaacttttctttatgtatgttgttcttcaataaaagctcactccaaaggcagggagagaagcaaatctatctaaatccaacagtttcctttgcctgaagccagatttcaatgaatctccacttcaaatgtcagatccccttctcagtatgctttttgtcattttattagcgctggcctgctttgcaaggatagctctttagacacttctttactgagagctcttggcagaaaccgggactcctctcgaagggtaggggtaagaggaattagagatattgatccaaacctgagttctacaggagatcctttcccatccatcctgccaaaccccaaagtgacgttttcattcgacgtcacaacgcttcattcagtgtgacacaggttctgtgtcacattcattctgtgacgcaggttctgaagaagaactcaacttcagtcctatggagaccactgaaagaggaagctccccgcagcaaagaaagtaaccaggaactgagttttgatgggaaatttgtctttcaaattcaaagcagtagattggaatgatatggatagcccagccttggaattgagatggccctcagaaatcagagcactgattttcacttgaacaactttgaaaagcctaaacaacaagggaatatctctctctctctatatatatatatcctggcctgtgatctctctacgtcccaggatggggtcggatgggcacagccgggcacagactgtccagagtgttagacgccaactgggtagctattcaattatgaatagttagaaaagagagagagagaaaagagaaaataactaaaagactctctaccataccactctccctcaagccctagaaagaggcaattctgaagtggttggtcgtcttggaaaataggttaatgattttacagatttcccagacaatgaaaaaatgatacatttatttctaggcaagtagatcagtttgcttctttatcataaaagagcttgaagaattcagtgaggttcagagggaaaaaaatgcttaaagaaaagttgctttcaaagttgtatttaaaaatcacatatacccttctatattttataagccattaaaaggctttccaagggcaaatttaaacattccaattagtcatcttacaagctgactttagaacataaagtatatgtaagatttaatttcattttatttctcaaccttataatggtcgaaagaaacagatactgtggggtgaagtaaaatctttgacccatacagtaaaatatgaggctgtaatgaactatttctttaaacctggtatttaccaagcatagagctatgttggtgctgagctgactttatgtttttttggccaggcactatgatggagaccgtgttacattatttcctttaatccattctctagtcctatgtggtagatagtaaattgtgcttttaaaataagggtactgggctgggcacagtggctcacacctgtaatcccagaattttgggaggtcaaggtgggaagatcgcttgagcccaggagtttgagccagcctggacaacctagagagactccatctctacaaaaaatttaaaaattagccgaacttgatggtgcgtgcttgtaatcccaactatcaggaggctgaggtggaaggatcacctgagcccgggaggtcaaggctgtagtgagcctggatggtgccactgtactccagggtgagtgacagagcgagaacctgtctcaaaaataaataagtaaataaacaaacataggggcactaaggtacatagaagttaaccaacctgtccaagttacagagcccacagctctcaatcaaatagatacaattctatgccagtgaaacttctggggcgaaagtcttttaggagacatagaaatgtgtcaaaattcaaaaagccctgaagattatttccagaaggaaggcacagaggagaaaaaagaaaatatttgaaaatacagtggtagaaaattcgcctgacctgaggggcagctttttgccaccaatgtctctgatacattaattattctctgctacattaagattttagtttttaattttaacaatttttcctcctgaatttgaattttctgtgtttgtttggtttgatgctttttctcacaagggtgaattgcctcaaatgtttgggaatttttagtcatcttttcatatttgtaaataagaatctgcattgatcagtctttgcagcaggagtgtattttctccagcctccgggttctaattttatgacaccactgcctatcattctgaaattattcgaaacactaatggaaaaaatcactttttagagatactcttcttcacttggatgagtttgcaattttctcaggttcactgtattttatcattttttaccctgttcccatcagctttgcattttttacaaaccccataaccatcatgtgggctgatgacactcctcccagcctcctagccctgctatggatattttattcatttactcatttgttcatatacccaactttttactgaagtctatacatacagaaaggtgaacatattgtgaggctataacttgattaatttttgaagagtatgcttgtgtaactatctcccagatcaagcagcagattcttcccaggaattccagaaacccatgtcctgcacctttccagatactaagcccccctcccaaggaagtcaactatcctgacctctagcaccatattaaacttgcctgttttgcactttatgtaagcaggattccacagtatatacactttgtgcactgcttctttaatctgtgtttggagattcacccctgttcttgcatgtagccatgctttatttgttctcatgaggtgggaggatagcctgagcctgagaggtcaaagctgtagtgagccaggaaggtgccactgtactccagcctgggcaacagagcaagaccttgtctcaaagcatatacctagcatatacctaagagtagaattgctggctttgattgattctattattacatatttctgtcatttcagtaggctttggaatgaacaaaatataaacacattagatctgtttgccatcttttacctgaaagcctaaagcatggttttgactgataagaatcatttacaattcaatagcaacgctattgctcatactttaaaaatttttatttaaaccaaaatgagaaaactttggagttcatcaccattaaaaacaatgacaaaacttgtggattttgttttgctcccttttaatactccaatatatattttgatttaaaaatttcttaagagaccaccacagaaaatatccattataaaacttatttctagaatcataaccatctttataaagctgcaattgaaaacaaaaaataagaagaaagaaaaaaaagagacatgaatagcctttttttctttcctgttgttttgatctgtatttgtccaagtatgcatctatgaataaacctagtccctcatccactaaccttcttttgaacttaaatgatttgtatgtggtctaatcatatttcctggtcccatggcactctagagtctaactgtgcatgccggtctcttatttccatacattgtatctcagagataaccaaatgcatggccaacttccctaattacagtcaccaggtcctggcggcctcctgcagtgccctctcttccctgcatcctttcacttttgtgttttcattttttccatctctctccctgaagtatactctccttcaaatttcccctggccctaaggagactgcttcaacatttgtttacatgtcaaaaataattgaagactaaattaattctcagcttcagtttatcaagccccttttcaattgtggctttttcccccttcagactttggaatttagcaactaggatagcctttgaaaacagaaaaaagcacaatagatattgatggatcacttgatagactgtatcctctaggcctagagtctatgattttatgattgattgatgtgctaggtttctttttgttttttcctcatgggttcccaacatctgattattaaattacacagagagagccattaagcatgtttgtaaagcccacattcttaatatctctgctccttttttttaaaagagacttaatggaaaacctaatataaacacctgaactgtgcattctttcatgagaggaagacatatttcataactccttatatactaaaaacacaatatattggccaaacatgtggaagacacacacacacacacacacacacacacacacacacacacacacactttgcctatttttgtattttatatatttactttcttatactttacatgttctgtgtaaatgaactagatatgtaacacattgagctatgtatatatagtagattgaatgtctgtgatgtcttaggaacacataggattggggattgtgacaggcagcttctgagatgacctcctaagaatttccacctcctgatatatttgctttgtgtaattccctcccgttgagtatgatctagtctagtgacttgctgttatgtaataaaatatagcaaaagtgataggataccacttcagtgactggatacaaaagactgtaacatttgtatttcaagtagattctctcaattgactctatcctttcatggctttagtaaggcaagttgccatcttgagagactcaagggacaagaaattgagggcagctgctggccagcagccatctagaaattgaggacttcaatccaaccagcccttgaagaactgaattttgccagcagacacatgaattgggagtggatactttcccagctgagacttacatgaggctgcagccctggctgatacctcaattgtagcctcttaaagattctgatatagagaccccagataagtcatgcctagacttagagaaattgaaaataataatcacaccttattttctccaataagtttgttaatttgttatatggcaataaaggccacatttgtggaatgcatgctcagtactcaacaagggaatgggcagctgatatacagaatctcatttggttgtaacaatcattctgcaaagtaaggctttggttgagatataagcatgactgcaaattgcacagatgcagaaaaagacacttctgacaagttagttagctcaacctgcccaaggtgacatggagccaagattttactttattttttcttttatatatatatatattttttattatactttaagttctagggtacatgtgcacaacatgcaggtttgttacatatgtatacatgtgccatgttggtgtgctgcactcattaactcatcatttacattaggtgtatctactaatgctatcccttcccccaccccatagcaggccctggtgtgtgatgttccccttcctgtgtccaagtgtgctcactgttcaattcccacctatgagtgagaacatgcagtgtttgttttttcgtccttcgatagtttgctgagaacgatggtttcaagcttcatccacgtccctacaaaagacatgaactcatcatttttttaatataaaatataaaatttttatatatatattttttattatacttttaagttttagggtacatgtgcacattgtgcaggttagttacatgtgtgtacatgtgccatgctggtgcgctgcacccactaactcgtcatctagcattaggtatatctcccgatgctatccctcccccctgccaccaccccacaacagtccccagagtgtgatattccccttcctgtgtccatgtgatctcactgttcagttcccacctatgagtgagaatatgcggtgtttggttttttgttcttgtgatactttagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccacaataaacacacgggtgcatgtgtctttacagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttctttggagaagtgtctgttcatgtccttcgcccactttttgatggggttgtttggttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctagggtttttatggttttaggtctaacgtttaagtctttaatccatcttcaattgatttttgtataaggtgtaaggaagggatccagtttcagctttctacatatggctagccagttttcccagcaccatttattaaatagggaatgctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccactttcacgatattgattcttcctacccatgagcatggcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagaactcatcatttttatggctgcaaagtattgcatggtgtatatgtgccatattttcttaatccagtctatcattgttggacatttggcttggatccaagtcttcgctattgtgagtagtgccacaataaatatgtgtgcatgtgtctttatagtagcatgatttgtattcctttgagtatataaccagtaatgggatggctgggacaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgggagatgatatctcattgtgattttgatttgcatttctctgatggccagtgatgataagcattttttcatgtgtctgttggtggcataaatgtcgtcttttgagaagtgtctgttcatatccttggcccactttttgatggggttgtttttttcttgtaaatttgtttgagttctttgtagattctggatgtattagccctttgtcagatgactaggttgcaaaaattttctcccattctgtaggttgcctgttcatgctgatggtagtttcttttgctgtgcagaagctctttagtttaattagatcccatttgtcaattttggctttggttgccattgcttttggtgttttaggcatgaagtccttgcccatgcctatgtcctcaatggtattgcctaggttttcttctagggtttttatggttttaggtctaacatttaagtctttaatccatcttgaattaatttttgtataaggtataaggaagggatccagtttcagctttctacagatggctagccagttttcccagcaccatttattaaatagggaatccttccccatttcttgtttttgtcaggtttgtcaaagatcagatagttgtagatgtgtggtattatttctgagggctctgttctgttccattgttctatatctctgttttggtaccagtaccatgctgttttggttactgtagccttgtagtatagtttgaagtcaggtagtgtgatgcctccagctttgttctttgggcttaggattgacttggcaatgtgggctcttttttggttccatatgaactttaaagtcgttttttccaattctgtgaagaaagtctttggtagcttgatggggatggcactgaatctataaattaccttgggcagtatggccattttcacgatattgattcttcctatccatgagcttggaatgttcttccatttgtttgtgtcctcctttattttgttgagcagtggtttgtagttctccttgaagaggtccttcacatcccttggaagttggattcctaggtattttattctctttgaagcatttgtgaatgagagttcactcatgatttggctctctgtttgtctgttattggtgtataagaatgcttgtgatttttgcacattgattttatatcctgagactttgctgaagttgcttatcagcttaagaagattttgggctgagacaatggggttttctagatatacaatcatgtcatctgcaaacagggacaatttgacttcctcttttcctaattaataccctttatttctttcccctgactgattgccctgggcagaacttccaacactatgttgaataggagtgataagagagggcatccctgtcttgtgccagttttcaaagggaatgcttccagtttttgcccattcagtatgatattggctgtgggtttgtcataaatagctcttattattttcagatacgtcccttcaatacctaatttattgagagtttttagtatgaagggctgttgaattttgtcaaaggccttttctgcatctattgaggtaattctgtggcttttgtctttggttctgtttatatgctggattatgtttcttgatttgcgtatgttgaaccagtcttgcatcccagggatgaagcccacttgatcatggtggataaggtttttgatgtgctgctggatttggtttgccagtattttattgaggatttttgcatcaatgttcatcgggatattggtctaaaattctctttttttgttgtgtctctgccaggctttggtatcgtgatgatgctgtcctcacaaaatgagttagggagaattccctctttttctattaattggaatagtttcagaaggaatggtacccgctcctccttgtacctctagtagaattcagctgtgaatccatctggtcctggactttttttggttggtaagctattaattattgactcaatttcagtgcctgttattggtctattcagagattcaacttcttcctggtttagtcttgggagggtgtatgtgtcaaggaatttatccatttcttctagattttcaagtttatttgcatagagatgtttatagtattctctgatggtagtttgtatttctgtgggatcggtggtgatatccgctttatcattttttattgcatctatttgattattctctattagtcttgctagtggtctatcaatttgttgatcttttcaaaaaaccagctcctggattcattgatttttttgaagggttttttgtgtctctatctccttcagttctgctctgatcttagttatttcttgccttctgctagcttttgaatgtgtttgctcttgattctctagttctttcaattgtgatgttagggtatcaattttagatctttcctgctttctcttgtgggcatttagtgccataaatttccctctacacactgctttaaatatgtcccagagattctggtatgttgtgtctttgttctcactggtttcaaagaacatctttatttctgccttcatttcgttatatacccagtagtcattcaggagcaggttgttcagtttccatgtagctgagtggttttgacagtggggtgttagactcccacacaattatagtgggagagtttaagtctctttctcagtctctaaggactttctttatgaatctgcgttctcctgtagtgggtgcatatatatttaggatagttagctcttcttgttgaattgatccctttaccattatgtaatggccttccttgtctcttttgatctttattggtttaaagtctgttttatcagagactaagattataacccctgcctttttttgttttccatttgcttggtagatcttcctccatccctttattttgagcctatttatgtctctgcacgtgagatgggtctcctgaatacagcacactgatgggtcttgactctttatccaatttgccagtctgtgtctttcaattggagcatttagcccatttacatttaaggttaatattgttatctgtgaatttgatcctgtcattatgatgttagctggttattttactcattaattgatgcagtttcttcctagcattgatggtctttctttacaatttggcatgattttgcagtggctggttccggttgttcctttccacatttagtgcttccttcaggagctcttgtagggcaggagtgttggtgacaaaatctctcatttgcttgtctgtacagtattttatttctcctttacttatgaagcttagtttggctggatatgaaattctgggttgaaaattattttgtttaagaatgttgaatattggcccccactctgttctggcttgtagagtttctgccaagagatccactgttagtctgatgggcttccctttgtgggtaatctgacctttctctctggctgcccttaacattttttccttcatttcaactttggtgaatctgacaattatgtgtcttggagttgctcttctcgaggaatatctttgtggctttctctgtctttcctgaatttgaatgttggcctgccttgctagattggggaagttctcctggataatatcctgcagagtgttttccaacttggtttcattctccctgtcactttcaggtacaccaatcagatgtagatttggtcttttcacatagtcccatatttcttggaggctttgttcttttctttttattcttttttctctaaacttctcttctcacttcgtttcattcatttgatcttcaatcactgataccctttcttccagttgatcgaattggctactgaaccttgtgcattcgtcacatagttctcgtgtcatggttttcagctccatcaggtcctttaaggacttctctgcattagtcaatctgattagccatttgtctaatcttttttcaaggtttttaacttctttgccatgggttcgaacttcctcctctagctcagagaagtttgatcatctgaagccttcttttctctacttgtcaaagtcattctctctctgtccagctttgtttcgttgctggtgaggaggtgcattcctttggaagaggagaggtgctctgatttttagaattttcagtttttctgctctgttttttccccatctttgtggttttatctacctttggtctttgatgatagtgacatacagatggggttttggtgtggatatcttttctgttggttagttttccttttaacactcaggaccctcagctgcaggtctgttggagtttgctggaggtccactccagaccctgtttgcctggatattagcagcagaggctgcagaacagcaaatattgctgaacagcaaaagttgctgtctgatctttcctctggaggttttgtctcagaagagtacccagccgtttgaggtatcagtctgcccctactgttgggtgcctgccagttaggctactcaggggtcagggacccacttgaggaggcagtctgtctgttcttagatctccagctgcatgctgggagaaccactactcttcaaagctgtcagacagggacatttaaatctgcagaggtttctgctgccttttgtttagctatgccctgcccccagaggtggagtctacagaggcaggcaggccttcttgagctgtggtggactccactcagttcaagcttccctgccgctttgtttacctactcaagcctcagcaatggtgggtgcccctccccgagcctcgctgctgccttgcagtttgacctcagactgctgtgctagccatgagtgaggctccgtgggcatggtaccctccgagccaggcacggggtataatctcctggtgtgctgtttgctaagattattggaaaagtgcagtattagggtgagagtgacctgattttccaggtgtcatctgtcacagctttgcttggctatgaaagggaattccctgaccccttgcacttcccgggtgaggcaatgcctcaccctgctttggctcatgctttgtgcactgcacccactgtccaacaagccccagtgagatgaacccagtacttcagttggaaatgcagaaatcacccgtcttctgcgtcactcactctgggagctgtagactggagctgttgctattcagccatcttggaaccccttggagccaagattttaaacctggactacagcctgagaagaatggaatgagagaaaagtaaaggatctgacatgggtcctgtttcatgggtgaggagtgagacagggggttgagctttaagtaggatgggttttgctatccccaaaacatagcagaaagtaaaacaaagcagggaaaaactaagtcatgctctatctgaataatactccagagaaggtacaaaattagtttaaattctcttgtattgggtaaaaatcaagtgaagttatagaaagggttcaaaaaagaatcacagaaattatgcctttttaacaaagccactgaagaaaaattgtttggtattcatttgaaatatacagtacattttttccaggaaagaaatgttttgcatcaagaccaggttcttacgctagctgtatatatatataaccataatgcagctgaaatactacaggtttgtaatgaaactaacagaatactggactcttaaaatgatccatattagatacagcagcaaaataaaccccactaagatagaaaaatacattgcttttagctaaactatttcctcaagaaaatcaattttaatagaaaatttgcaggtactctggactttggtaggaactttaaaattgatatcaccagttcaatattggtatttctgatttctttacaaaacaacatactttttcttgatacaaatatattgctagcattagtcttgttcataatagacatgaataagaacacagacaggatgaggtgttttagttgagagataactatataagaagttgggagggaaaatataaaggataaaggaattaagaaaataactgggcaacaaaaagatataaaatgtttgctggtggaagaatcagctcagttagatatgtaagtgaatccatcacaggagcaaatgggaatgctgactctacagattacctctgtgtatgcttagtcaattcctgggcctcagatttctcatcttaaagctggctctacaatgcttgtttctatattaaatagcctaatgtatatggcaattccttgtaacaacctgccatgatagtggactccgaatgatatttgttgaatctgaaactgaatctctgcagcctttataaggagaaataatggaagtcataaagaagaaaatttggattattcattgctgaagatagatttttctggtgagtgaaggagggaaggtgtgatggttagttttaggtgtcaacttgactggattaagaaatatgcagatagctggtaaggcattatttctaagcacgtctgtgggagtgcttccagaagagattggcatttgaattagtagactgggtaaggaagatctgcttccacctgatattgattggctctctccccacccggatctcatctagaattcccatgtgttgtgggagggacccagtgggaggtgattgaatcatgggggcaggtctttcccacgctgttctcatgacagttaatatgtcttatgagacctgatggttttataagaaggagtttccctgcacaagctctctttaattgccagcatccatgtaagacatgacttgctcctccttgccttccgccatgattgtgaggtctccccagccatgtggaactgtaaatccattaaacctctttttctttccagtctcagggtatgactttatcagcagtatgaaaagggactaatatagtaaattggtaccagtagagtggggcactgctgtagatacctgatatttggaagcaaatttggaacttggtaacaggcaggggttggaacagtttgaagggctcagaagaggacaggaaaatgtggaaaagtttgaaaccccctggagacttgttgaatggctttgaccaaaatgatatggacaatgaaatccaggctgaagtgatctcagatggagaggaggaacttgttgggaactggagcaaaggtgactcttgttatgttttagctaagagattgatggcactttgcccctgccctagagatttgtggaacactgaacttcagagagatgatttagggtatctggcagaagaaatttctaagtagcaaagcattcaagagattacttgggtgctgttaaaagcattcagttttaaaagggaaacagagcataaaagtttggaaaatttgcagcctgacaatgcgatagaaaataaaatcctattttctgaggaaaaattcaagctggctatagaaatttgcataagtaacaaggagctgaatattaatcaccaagacaatgggggaaaatgtctccagggcatatcagagacctctgcagcagcccctcccatcacaggtgcagaggtagtttaggaggaaaaaatggtttcatgggctcagtacagggtccctatgctatgtgcagtcttgggacttggtgccctgcattgcacctactccagccatgactaaaaggggccaatgtacagctcgggctatttcttcagagggtgaaagccccaagccttggcagctttcacatggtgttgagcctgtgagtacacagaagtcaagaattgaggtttgggatcctctgcctagatttcaaataatgtacagaaatgcctggatgcccaggcagaagtttgctgcaggagcagggcctcatggagaacctctgctagggcagtgtggaagagaaatgttggattggagcccccacacagagtccccactggggcactgcccagtggaactgtgagaagaggcccactggcctccagcccccagaacgataaatccactgacagcttgcactatgcacctggaaaagccacagacactcaatgccagcccacaaaagcagctgggagggaggctctaccctgtgaagccacaggggcagagctccccaaggccatgggagcccacttgcatcagagtgacctagatataagacatggcgtcaaaggagatcattttggagctttaagatttgactgccccactggattttggacttgcatggggcctgtagccccttcattttggccaatttctctcatttgaaatggccgtatttacccaatgcctacacccctattttatcaaggaagtaactaacttgcttttgattttacatgctcatatgcagaagggacttgccttgtcttggataagacttgggactgtggactattgagttaatgctgaaatgagttaagattttgggggactgttgggaaggcatgattagttttgaaatgtgaggacatgagatttgggaggggccaggggtggaatgatatggtttggctgtctcaccacccaaatctcatcatgaattcctatgtgttgtgagaggaacccagtgggagacaattgaatcatgggggcaggtatttaccatgctggtctcatgatagtgaataagtctcatgagacctgatggttttataaggagtttccctgcacaaactctcttcacctgccgccctccatgtaagattgacttgctcctccttgccttctgccataattgtcaggccaccccagccatgtggaactgtaaatccgttaaacctctctcttttgtgaatggcccagcctcaggtatgtctttatcagcagggtgaaaatggactaatacaccacccaacatggatgagtgcatccaatcagctaagggctgatgtagaaaaaaaggcaaaggaaaggtgaattcactctttctgctggagctgggacactcttcttctcctgcccttggaccacacaactacaggttctctggcctttgaacttcacaacttgcgccattcccctgctccccatcctggattctcaggccttcagcctcagactgagaattacaccattaccttctctggttctgaggcatttagacttggactaagctatgctacagctgccctggttctctagcttgaaaatagcctatcatgggactcctcaaccttcataatgacaagagcaaatcccctaataaatctcctatctgtcatctatctgtctgcctacatacttacctacccacctacctatctatctgttcatctatctatccacccatcatattgattccatctctggaaaatcctgactaatacatctatctaaagatgaaaagatcaaacagagacaaagcctagaaaatgtagcagagtctggctaaatgctcaccaaacccatttttctcttcttgttaagtgcagataaactaaattttgtgaacttctctcatatatgagtgagaccatgtcagcagttcttgccatagatagtgaatgaaagtgatttgtcacttgcagttcagtgacagaagttacataagaacctgccttgtctttgcactcccttcttcccatctgccagctagatgatgtcaggacaacccctaactgtgtattgaaggagactaccacatgggaggagcctgagtacctgaatggttgcatggagaagaggcccactcccacactatctaaatttgaactagggagtgaatagaaaagaaaccttcactgtgttgatccattgagaacatgaaattgtaatagaagccagcattatttacaagtagaacataaatgggggaaaagggggaatattatgtaacaacagctaaatttatgtatacttaggaagtgaatgtccagatttaaataagagataaattacttggtaattctgtatgtcaccaaaatattccccttgtattcctttcagtggtcagcttctactgtccatttaaaaatattgcattttcagtatgtttgtgggtacagtcattataggaaaaagggatctaccagcatgctacccaaactgactgcactgtaatggattcccaaaggaggtgagatagctctccactggagaggagtttattttgtagtcaacaaagtgcaagagtgtattttctgagatatttgcttaggagctcaaaatttaaacttgcaacattggcttagccacttgtttaagataataaaagttgcacccattggagatattatattcagaatgcccattgtgtatatttttctaattaattggactttaattactttgcagaaaatctataaagagtcatcaaagttttgaagatgagaacaagctggtacatattccgtttactttccatagagctatctcaccatgaaacctaagaaaaaaaaatagccaatttaattttcttctgttgaggtttataaaaggcccaacagaggctactatgtccaatttttaatagagataactatttagaaatataaatgctgagaaggagaataggctcaggtatgctctgctaaatcaaggtgacccttcatgttagtttcttctagtacttttctttgtatatacaaatttatacacacacacacacacacacacacacacacacacacgcttgcatatctgctcattattcagcccaagctaggttaaaaaaaaaatccaacaagaatgtagtaacataaagctaattccttgatttttctcatttccatatttttgggggggtactttcctacattggagggtaaaatacaaaggattatacttgtaaatgtttaaggaaatgtatttaacctcaattactgaatatatggttcgaatatatggttcagtggggaaaagggtgaagatacaatgttaagacataatcattttactagaaggaaattgttcacagtcacctggtaagaggaacttatgtaccactgatggaaacagaatgatggggaattgagtggtaaggaaaggaatactgagtgtgttctgggctgtatcctgccctttcctctattatagtattggtgttaaatggaggaggagccacttttaaatctcaccctaaatatgtccagtgtagtcaatacgaaaaaaattattttttggcatttggagcagtacagcagactagatagggagctagaagctaaataaaaagtgaaacctgaaattaaatacccctcgaaatccatcagttctgtatggctgagatatatccttacctagagggagatgattgcccttgagggcatctcaaaaaattctttccagctctgcactttgatgctctaagtttctgagttgagagataattggctgaatattttgtctttgacttggaatttcaaatcttcaaccttgtcctggatgcggttgcaacaatgcttattttctgaccacggctactgatatctacacttcataatactgttaagtattttcttgtagcctgaattagtttaacatttctgacaatgaattcccaagtaattgcggtggcttcactccatgatatgtctctcagggcactcttggaaattaaatgttacttcttctcaacagttatttgcttacttcatcctcattttattaaataatcataaaaaactttcaaatttaaatatgcctgctctgttatctgaaaggtctggcaagacaggaaggctggatgaaacaaagccagccctggtctctttgttatttttcagtgaattttccattggcattgagtgcatcccaagtctggggctttaaggagctttaaagctgtgtgctcactggggtcctggttgattttcagcaactaaagctgaaattgctgctgtttagaggtggcccaaacattcttaacaatgtttaaaatacctaacctcattagagcaaaataataatctattttttcttttgtttttgaatagtttttttttttttacaagactcctaaagatttattttggttgaataaataagtaggaagggttccaagacccatgcaggtgatcttgtgacaattattagacacttgatctgggtccagttggttacgaggccttgcctctcattttaggcatgctgtcttctagaagacttacatgaggttacccgactgaagaatttggaggggagaatattgtcctcatttaaagaagttcactcaatgagacattagtgacttgtttaaatttaacaaaatggagttagttatgctgaattcccagctcaactattccagagcagcatggggtagcagggaggtcatgggctttgaacatagacacacttgatttgattccaggagctaccctttcctagctgtacatccttctacatcttagtgatctctgagtgtcagatctctaaaaagcaaaatagagtccaacttatagggttaatatgaattatcaaaaaatacctttaatgtacctaaactataatcaataataataaatgatagacacttattatttcttgtattaattccaacacattgcttggtttaaggctgacagttgtgatatgaatcatgatatagcccagaaatgttatttagaaagtcttaagttttatttcctcccttgaccacccaacatgatagtttcttcatcatcacaatatatatgtctaatgttttcacaaagaaggctgtgtgtattagctaacgcaaaagaaagagaaaaattgcattcttatttcaattttccctctcttaattctattgcgtgatcttaggcaagtaagtacaattttgcatttcgttgagaggaagggcagaggactttatctgctatatctgtgtaattatttccaagacacaagtgagagtgactgcaatattgtccctcaagtacttggcattccttagaagaaaacatgatgtaattgggctttaataacttggatgaaaatgtatcctagggccataaaatgtttctctacaacattagatctaggcgagttattatgattacctcttaagaagtgttcagattaacggatatgtgcttataaagtccattacaaaggcagaatcagaaggaagaggtacagaagagtacccggatatttcaatgcattttattcctgaacattttaaatggagaagttcttttatcacttgtactgccaggctcagtgggggaatacctgaacaaggaggcctgctctgaatactatgtctatctccctacttgccctccattagaagattgcttaaagaaactcctttctgtagccatgcttgatgattaatgttaggtgtcgacttcactgaatagagggctgcctagatggctggtgaagcattgtttctcggcgtctctctaagggtgttttaagagaagatttttatgtgagttggtggactgagtggtgaagattgcgctcaatgtgaatggacatgattcaatcagcttggggccctgatggaacaaacaggtggaaaagcatcaattctctctttcttcaggaaagggacactcttcttctcctgcccttggacatcagaaatccaggttcttcaagctttgaactctgaaacctgcacctttagcctcccaggcctctcaagtctttggtcttggattgagaattacaccaccagcttctttagttctcaggcctttggacttattctaagccctgctactggcttctctggttctccagcctgtgataatacttatcagcctccataatcatggaagccaattcccctaataaatcccttatctttctgcctgtctgtctgtctatctatctatctatctagtctgtctatctatctacctatttttctatctgtcctattggctccttctctggaaaaccctgaccgaatatactatgtgtataggtaagggcaatgatatggaagtcaaaccagttcacccttccaagctatgtgattcattgcaacattcattcagtaaacactgagtgccttctgtgctaggagttatatatacaacatgattcttgacttcagttgaaaatggtttagtggagggaaacagatgtgcataaataaatctatttatctcctaaagcattttatggcttatttcccatagttgattattcttagccaattatagtaatttcatccttcattcccccaccccacacccctgctattgatgaattcagggatagagctttaagtctaagctaacttgaaaactaaaacattaggagtaatttttagacacttatgggaaaaatgccctcatgggctaaagaggtcatctaatgcctttaaggtatactaccttagaatgatgttaaatttgccaactgcagagtagagcgtgggaagtttactgtgtcctaggtgatacacataagcagctgttttaagcaatctgaagacttcttgctctgcctgtggacttgatgttatctgagctaataaatgactttattgcttaaccaagtctgaaataaatttttacttacttgcagccagaaccatcctagctgaatgctagtttaatttaatgctttccatatcacgtcatcatgacagtcccctccaattcttgtttaaaacgcaaactctcaagtaacccttaaggagaatctgacccactgatccactaggactgatataaggcccaggaattgggatttttaataactgtcccaggtgatttatgttcagccatatttcagatcattgttctgactgctataatagagacaagaattaagtgcaggcttagcaatggactcagcctggaggagttagagatggtctctcagacaaagggacatttgagctgtgccttgaagaatgagtgggtgcttgctaggctgagaagaggtgcaaagatgttcccaacaaaggaagtctcaacaaaatacttatctctctggcctttattatctcatctataaactgaggacattataaaagaaagtctaggactgggccaagatggccaattaaaagcagctacagtttgcaacactcatggagagaaaagaaaatggcaagtgaattcagcaccttcaactgaaatatccagattctcacattgggattgactaggcaaacatctcgacccacagagaatgaagaaaagcaggatggggtgatggcccacctaggagtggcatagagccaaaggaaccaccacccccagccaagggaagtggtgagtgattgtgtgattccacctgggaaatcatgcttctcccacagatctttgcaaccagcagatcagggatccccttctaagcccataccaccaaggccttgggtctgatacagagagctgtgtgaagtccctgcagagcagccactggggcacacacagagacccaggagttttgcatactgtggccccaggatttctgacaaggtaagagatctgtccctacatcccctaagaggggagctaaatccagggagctgagcagcatcattctgcaggccccacttccacaatacctcacaagttaagacacactggcttggaattccagccagccagtggcaacaggctggagtctgcctgagaaggacaaagttcctggacagaggggtggctgccattctgtgttctggttgactcagcttttccagcctgccaactctggagagtctggacagtccagatgaggaagggtcccccacaacacagcacaattctgctaccaaaaaaaaccagactgcttcttggagcaggtccctgataccattcttccagattggatgagacttctcaacagaggtctccagctacctcctttagatacaatttgggctggcaacatgtccgtacttccctgggactgagcttctcaaggaagaagcaggctgcaatctttgctgttttgcagccttcactgattgataatacttcaaggtacatgaaaaaccaaggcaactagggtccatagtggacccctagaaaatggcagcagtcctacagaagaatagcttgactgttaaaagtaaaacagacaaacagaaaacaacaaaaacaacatcagcaaaaagatcccacaaaaactcctttccagggtcagcagcctcaaagatggaaggtagttaaccccacaaagatgagaaagaatcaacacaaaaaccctgaaaacccaaaaagccagagtgccttatatcctccaaattattgcagcatctctccaggaagggcacagaacagggctgaggctgagatggctaaattgacagaagtaggcttcagaaggtggataataataaactttgctgagctaaaggagcatgttgtaacccaatgcagagaagctataatcatcataaaacaatacaaaagctgatagccaggacagccagtttcgagatgaacataaccaacctaaaggagctgagaaacataacacgagaaatttacaatgcaatcacaagtatcaatagcagaatctcagagcttgaagaatatctttctaaaataggcagataagaatagagaaaaataatgaaaaggaatgaacaaaacctccaagaaatatgggatcatgtaaagacactgtgcctacaatggattggggtacctgaaagagatgagaatggaaccaagttggaaaacatacttcaggatatcgttcagaacttcttcaacctagtaagacaggccaacattcaaattctggacctgcagagaatcccattaagatgctcccccagaagatcaaccccaagaaacataatcatcggattctctaaggtcaaaatgaaagaaaaattattaaatgcatccagagaaaggccaggtcacctacaaagggaagcccatcagactaacaatggacatctcagaagaaatcctacaagccagaagatattgggggccaatattcaacattcttaaaaaaaatttccaacccagaaatttatgtctggccaaactaagcttcataagaaaaggagatataagatcttctttggacaagcaaatgctggaggaattcattaccaccagacctgccttgcaagagctcctgaaggaagcactaaatatggaaaggaaaaactgttaccaaaagtatttttttacaaaagcacactgaagtacacagaacagtgacactatgaagcaaccaaccacataaacaagtctgcaaaataactagctagcctcatgatgacaggatcaaactcacatataacaatacaaagcttaaatgttaataggcaaaatgccccaatgaaaaggcacagaatctcaagctggataatgagtgaagaagacccattggtatgttgtcttcaagatattcatctcacatgcaaagaaacacatagtctcaaaataaaggaatggaggaaaatttaccaaatggaaaacagagaaaagcagggattgcaatccttgtttctgacaaaagagactttaaaccaacaaagataaaaaaaaagacaaagaagggcattacataatggtaaagggttcaattcaacaagaactagctatcctaaatatatatgcactcaatacatgagcacccaagttcataaagcaagtttttagagacctacaaaaagacttagactaacacacaaaaatagtgggtgacttcaacactccatggacgttattagacatatcatcaaggaagaaaattagcaaagatactcagaacctgaactcggctctggatcaagtggacctgacagatatctatagaactctccacccaaaacaacagaatatatattcttctcatcactacacagcacttcctctaaaatttataaataattggaagtaaaacactcctcagcaaaagcaatgttataactgaagttataacaaacagtctgttagaccacagtgcaatcaaattagaatgcaagattaagaaattcacttaaaactatataactacatggaaattgaacaacctgctccggaatgattcttgggtaaacaatcaacttaaggcagaaatcaagaagttctttgaaactaataaaaacaaagagccaatgtaccagaatctgtgggatgcagctaaagcaattctaagagggaaatttatagcactaaatgcccacattaaaaaactagaaaagtctcaagttaacaacctaacatcacaactaaaagaacaagaggaccaagagcaaacaaatccaaaacattgcaaaagacaataaataaccaagattagaggtgaactgaaggagatagaaaccccccaaaattcaaaaatcaacaaatccaggagcctgttttttgaaaaaaataataaaatagatataccactagttagactaataaagaagaaagaagaatcaaagaaacaagtcagaaatgatgaggatatcaccactgaccccacagaaatataaacaaccatcacagaatactataaactcctctatgcacataaactagaaaatctagataaaatgaataaattcctggacatatgcacccacccaagactgaaccaggaaaaaaattgaatccctgaagagaccaataataagttctgatattgaggcagtaatagatagcctaccaatcaaaaaaagcccaggaccagaagaatttacagctgaattctaccagaggtacaaacaagagctggtacaatttacactgaatgtcattgatcacataaacagaactaaagacaaaaatcacatgattgtctcattagatgcagacaaggccttcaataaaattcaacatcctgtcatgttaaaaactctcaataaactaggaactgaaggaacataccttaaaataataaaagccatatataaccaacccacagccaatatcacactgaataggcaaaagctgaaagcattccccttgaaaactagcaccagaaaagggtgtcctctcttaccactcctattcaacacagtattggatgttctggccagggcaatcaggcaagagaaagaaataaagggtatttaaataagaagagaggaaatcaaattatttttgtggatatcatgatcctatatctagaaaactccattatctccacccaaaagcttcttaagctaataagcaacttcagcaaagtctcaggatacaaaataaacatgcaaaaattgctagcattcctatgcactaaaaacaggcaagcagagagtcaaatcatgaatgaattctcattcacaattgctacaaaaaggataaaatactgaggaatacagctaacaagggatgtgcaggacttctttaaggagaactacaaaccactgcttgaagaaatcagagaggacataaataaacagaaaaacattccatgctcatggataagactcaatattgtgaaaatggccatattgcccaaagtaatttatagattcaatgctattcccattcaactaccattgacattctttacagaattaattagaaaaaaaaatttaaaaattcatatgaaaccaaaaaagagcccatatagccaagatgatcctaagcaaaaagagcaaagctggaggcatcacactacctggcttcaaactatgctacaaaccaaacagtaaccaaaacagcatggtactggtaaaagaacagacacatagaccagtggaacagagtagagaactcagaaataagacctacaaccatctgatctttgacaaacccgacaaatccagcaatggggaaaggattccctatttaataaatggtggtggaagaactggcagccatatgcagaaaattaaaactggacctcttccttacacgatatacaaacattaactcaagatggtttaaagacttactgaaatgtaaaacccaaaattataaaaaccctgaaagaaaatccaggcaataccatttaggaaataggcatgggcaaagatttcatgacaaaagcacaaaagcaattgcaacagaagcaaaaattgacatatggaatctaattaaactaaagagcttctgcacagcaaatgcaactctcatcagagtgaacagacaacctacaaaataggagaaaatttttgcaatctatccatgtgacaaaggcctaatatccagagtctataaggaacttaagcaaatttaccagaaaaaaacatacaaccccattaaaacgtgagcaaagcacatgaacagacacttctcaaaagaagacatgtgttttcaactcctagggaatcatggcagatgggaggcaggactagactgcagctctaactcagacagagcagcatgtggaggcttgcattatgaatttctgctccagaacaactgcaggaataaatcaggaaacctgaaaggacccacagacccctgaaggaagcggattgctcctgcaggacccaggagacatgccaaatactctgctggtattcacggctgacagacctacagatgtttcacatcacaggactctgcagaaaatccccagtactggcccagagcctggtagacttgctgggtggctagatccagaagaaagataacaatcactacagctattctctcaggaagccacatccataggaaaagggggagagtactacctcaagggaacacactgtgggacaaaagaatctgaatgggacaaaaagaatctgaacaacagccttcagccctacaccttccctctgacagagtctacccaaatgagaaggaaccagaaaaccaactctggtaatatgacaaaacaaggttatttaacaccccccaaaaatcacactagctcaccagcaatggacctaaaccaagaagaactccctgatttacctgaaaaagaattcaggatgttagttattaagctaatcagagacgtctttgaattaacccaatccaacgaagacaaagaaaaaagagtaagaaaatatgaataaagcctccaagaagtctgagattatattaaatgaccaaacttaagaataattggtgctccagaggaagaagagatatctaaaagtttggaaaatatatttgggggaataattgaagaaaacttccctggccttgctagagacctagacatccaaatacaagaagctcaaggaacacctgggaaattcatcacaaaaagatcatcgcctaggcacattgtcatcgggttatataagttaagacggaagaaagaatcttaagagctgtgagacaaaagtaccaggtaacctattaaaataaagaaacctatcagattaacagcagatttctcagcagaaaccgtacaagctagaagggattggggccctattttcagcttcctcaaacaaaacaactatcagccaagaattctgtatccattgaaactaggcttcatatatgaaggaaagatacagtctttttcaggcaaacaaatgctgagagaatttaccactaccatgccaccactacaagaactgcttttcaaaaagtgctctaaattttgaaacaaatcctggaaacaacatcaaaacaaaaccactttaaagcataaatctcacaggacctataaaataaaaataccatttaaaaaatgaagtcaaaaaaaccaaggtacacaggcaacaaatagcatgatgaatggaatggtacctcacatttcaatattaacattgaaggtaaattacctaaatgttctacttaaagatacagaattgcagaatgaataagaattcaccaatgaactatctgctgccctcaagatactcatttaacacgtaaggactcacacaaacttaagtgaaaggggtgaaaaaagagacatcatgcaaacggacagcaaaagtgagcaggagtagctatagttatgtaagaaaaaacaaactttaaagcagcagtagttgaaaaagacaaagaaggacattatataatgataaaaggccttgtccaacaggaaaatatctcaatcctgaatgtatatgcacctaacactggagctcccaaatttataaaacaattactaatagacctaagaaatgagatagacagcaacacaataatagtgggggactttttaatacaccactgacatcactagacaggtcatcaagacagaaattcaacaaagaaacaatggatttaatctataccctagaacgaatggacttaacagatatatacagaacattccatccaacaactgcagaatatacattgtattaaacagcacatggaactttcttcaagaaagaccatatgatagaccacaaaatgagcttcaataaatttaagaaaattgaaattatatcaagcactctctcagaccacaatggaataaaactggaaatcaactccaaaaggaaacttcaaagccatgcaaatacatggatattaaataacctgcttctgaatgatcattgggtcaaaaattaaaccaaaatgaaaattaaaaaattctttgaactgaatgacaatagtgacacaacctatcaaaacctctgagacacaaaaggcagtgctaagaggaaggttcatagcactaaatacctacatcaaaaagtctaaaagagcacaaacagacaatctaagttcacacctcaagtaactaccaaaacaagaacaaaccaaacccaaacccagcagaagaaaggaaataaccaatatcagagcagaactaaatgaaactgaaacaacaacaaaaatataaaagataaatgaaacaaaaatctggttctttgaaaagataaatgaaactgatagaccattagcaagattaaccaagaagagagaaaatccaaataagttcaataagaaataaaacaggagatattacaactaacaccacagaaataaaaaagatcatttaaggctactatgaacatctttacatgcataaattagaaacctagaagaaatggataaactcctggaaagatacaactctcctagcataactcaggaaaaattagataccctaaacagaccaataacaagcagcaagattgaaatggtaacgtaaaaattaccaatgaaacaagttcaggaccagacagattcccagacgtattcacagcagaattctaccagacattcaaagaagaattgctaccaatccgattgacactatttcccaagatggagaaagagagacccttccctaaatcattctatgaagccagtatcaccctaataccaaaaccaggatctagcccaaaaagaaaactacagaccaatatccctgatgaacatagatgctaaaatcctcaacaaaatactagttaactgaatccaacaatatatcaaaaagaaaattcaccatgatcaaatgggtttcattccaaggatgcagggtttagcataggcaagtcaataaatgtgatacaccacataaacagaaataaaaacaaaaacacatgatgatctcaatagatgcagaaaaagcatttgacaaaatccagcatccctttatgattaaaactctcagtaaaatcgacatacaagggacatacctcaatataataaaagccatttatgacaaacccacagccaatataatgctgaatggggaaaagttgaaagcattccctctgagaactggaacaagtcaatgatggccactctcaccactcctcttcaacttagtactggacatcctagccagagaaattagataagagaaagaaataaagggcatccaaattggtaaagagggagtcaaactgctgctgtttgctgatgatatgattgtttacctagaaaaccctaaagactcctccagaaagctcctagaactgataaaagaattcagcaaagtttccagatacaaaattaatgtacacaaatcagtagctcttctatacaccaacagttatcaagctgagaattagatcaagaactcaaccccttttaaaatagctgcaaaacaaaaacaaaaacaaaaaacatgaaaaaaacttaggaatatgcctaaccaaggaagtgaaagacctctgcaaggaaaactgcaaaacattgctgaaataaatcatagatgacacaaacaaatggaaacacatcccatgctcatggatgggtagaatcaatattgtgaaaataacgttactaccaaaagcgatctacaaattcagagcaatacccatcaaaataccaccatcattcttcacacaattagaaaaaaaattctaaaattcatatggaaccaaaaaagagtccaaatagccaaagcaagcaaagcaagactaagcaaaaagaacaaacctggaggcatcccactacctgatttcaaactatactataaggccatagtcaccaagacagcatggtactggtataagaataggcacatagactaatggaacagagtagagaacccagaaatgaacccaaatacttacaactaactgatcttcaacaaagcaaacaaaaacatagagtggggaaaggacacccttttcaacaaatggtgctgggataattggctagccacatgtaggaaaatgaaactggatcctcatctgtcaccttatacaaaaatcaattcaagattgattaaggacttaaatataagacctgaaaattaaaattctagaagacaacataggaaaaacccttatagacactggtttagggaaggatttcatgaccaagaacccaaacacaaatacaataataacaaagataaattgttgggacttagttaaactaaagagcttttgcacggcaaaaggaacagttagcagagtaaacagacaacccagagtgggaaaaaattctcacaatctatacatctaacaaagggctaatatccagaatctacaatgaactcaaacaaatcaacaagaaacaaacaatcccatgaaaaagtgggctaaagacatgaatagacaattctcgaagatatacaaatggccaacaaatatgaaaaaatgctcaacatgactaatgatcagggaaatacaaatcaaaaccacaatacactgccactttactcctgcaagaatggccataatcaaaaaatcaaaaaaatagtagacgttggcatggatgtggtgaacagggaacacttctacactgctggtgggaatgtaaactagtacaatcactatgaacaacagtgtggaaattccttaaagaactaaaagaagagctatcatttgatccagcaatcccactactgatacctacccagagtcattatacaaaaaagatacttgcacacacatgtttatagcagcacaatttgcaattgcaaaaatgtggacccaactcaaatgcccatcaattgataagtggataaagaaactgtggtatatatacacagtggaatactactcagccataaaaaggaatgaattattggcattcgcagcaacctggaggagactggggactatgatttgaagtgaagtaactcaggaatggaaaaccaaacattgtatgttcacattcataagtgggagctaagctatgaggatgcaaaaacataagaatgatacaatggactttggggactcagggaaagggtgggaaggggatgagagataaaagactacaaatagcgtgcagtgcatactgcttgggtgatgggtgcaccaaaatctcacaaatcaccaccaaagaacttactcatgtcaccaaacaccacctgttcctcaataacatataaaaatgaataaatacaaagatatacatgtggctaacatatgaaaaatagctcaacatcactgatcattagagaaatggaaatcaaaaccacaatgagatatcatctcacaccagttagaatgggtattattaaaaagttaaaaaacaacagatgctggcaagattgcagagaaaaagaagtgcttttacactgttggtggagtgtaaattagttaaaccattgtggaagacatcgtggtgattcctcaaagacaggaggcagaaataccatttgaccgagcaatctcattacccagaggaatataaataattctattatatagatgtattatgcattatataatacattatatagatgtattatgcattatataatacattatatagatatgtattatatagatgtatatttattacataaatcattctattataaagatacatgcacgtttatgttcatggcagcactattcacaatagcgaagacatggaatcaacctaaatgcccatcaatgatagactggagaaagaaaatgtggtacatatacgccatggaatactatgcagctataaaaaggaaggagattatgtcatttgcagagacacaaatggagttggaagccattatcctcagcaaactaatgcgggaacagaaagccaaacaccatgtgttctcacttacaagtgggagctgaactttgagaacacatggacacatcaaggggaacaacacacactggggcctctcgaggggtgtaggtgaggggagggcaagccccaggaagaataactaatggctgctgagcttaatccctaggtgatgggatgatctgtgcagcaaaccaccatggcacatgtttacctatgtaacaaacctgcacatcctgcgcacatacactgaacttaaaagtggaagaaaaaaatatatatatatataaatgtatggccaaaagaaaaaaaaaggaaagtctccatttcctctaataccttctgtttcaatattaactggaaagtgagaaatctaagtgccctttgcttattgatcaacctcataatattcaatgcagtaagttgtgagatttctctgagaatgtctttctattggaaaaataatggaaatattttgtaagctgtattataatacaactatcatgcaggcagaggcattgtatttcctgtttgcttttgtatctgtatcaaaataggatatctgacccatatagactcaaacgtggttagtgagtaagtcagttgaattaaatttattcaagtggccaatttcatatagaacttttaaagattaatttcatgtgtaaacaataatactttaagtgtagtgatgataatatcaataatattaatacttggaatttacctaatgactttatatttttaaatcatccattcattaaaaaaaatgtattgagaattttctaggtatcaggtcctattcagtgcaatgggaataaagcagtaaataagaattcatgccctcacattctcacattctggttgaagaggagaaatatctcttacatctctaatctaaatgtaagtatgattgtttataatccatagatgaggaaaatgaatttcgtatctctaaaaggtcaatttgccaaacttgtggcacaaaccagaagttacacggcttcaagcatagtaattaatatatttcttattccttctcagagtttgtgacacttgatgaggctcccttcaaatgagcaagtattgaagttcatgccatgtgcccagctcctcctggatctgtgaggaaatatctgaaaccttcaagatgttgtacatgtcttatggaaaatgttgctccatcatccctgcactcccttatctagtatatctacctccataagaaaacataaggacaggcaatcttcataaaaatagactccacctatt
